(12) United States Patent
Spira et al.

(10) Patent No.: US 9,585,930 B2
(45) Date of Patent: Mar. 7, 2017

(54) THERAPEUTIC AGENT FOR EMPHYSEMA AND COPD

(75) Inventors: Avrum Spira, Newton, MA (US); Marc Lenburg, Brookline, MA (US); Joshua Campbell, Quincy, MA (US); Dimitri Petchkovski, Vancouver (CA); Darryl Andrew Knight, Vancouver (CA); James Cameron Hogg, Vancouver (CA); Julie Erin Zeskind Gil, Brookline, MA (US)

(73) Assignees: Trustees of Boston University, Boston, MA (US); The University of British Columbia, Vancouver (CA)

( * ) Notice: Subject to any disclaimer, the term of this patent is extended or adjusted under 35 U.S.C. 154(b) by 0 days.

(21) Appl. No.: 14/004,781

(22) PCT Filed: Mar. 20, 2012

(86) PCT No.: PCT/US2012/029823
§ 371 (c)(1),
(2), (4) Date: Mar. 20, 2014

(87) PCT Pub. No.: WO2012/129237
PCT Pub. Date: Sep. 27, 2012

(65) Prior Publication Data
US 2014/0199411 A1 Jul. 17, 2014

Related U.S. Application Data

(60) Provisional application No. 61/454,566, filed on Mar. 20, 2011, provisional application No. 61/498,297, filed on Jun. 17, 2011.

(51) Int. Cl.
*A61K 38/06* (2006.01)
*A61K 38/07* (2006.01)
*A61M 11/00* (2006.01)
*A61M 15/00* (2006.01)
*A61M 16/10* (2006.01)
*C12Q 1/68* (2006.01)
*G01N 33/53* (2006.01)
*G01N 33/00* (2006.01)
*C40B 30/04* (2006.01)
*G01N 33/68* (2006.01)
*A61K 9/00* (2006.01)
*A61K 45/06* (2006.01)
*A61M 16/14* (2006.01)
*G01N 33/543* (2006.01)
*G01N 33/569* (2006.01)

(52) U.S. Cl.
CPC ............ *A61K 38/06* (2013.01); *A61K 9/0073* (2013.01); *A61K 45/06* (2013.01); *A61M 15/009* (2013.01); *A61M 16/14* (2013.01); *C12Q 1/6881* (2013.01); *C12Q 1/6883* (2013.01); *G01N 33/54306* (2013.01); *G01N 33/56966* (2013.01); *G01N 33/6884* (2013.01); *C12Q 2600/136* (2013.01); *C12Q 2600/158* (2013.01); *G01N 2500/04* (2013.01); *G01N 2800/122* (2013.01); *G01N 2800/60* (2013.01)

(58) Field of Classification Search
None
See application file for complete search history.

(56) References Cited

U.S. PATENT DOCUMENTS

| 4,767,753 | A | 8/1988 | Pickart |
| 7,632,803 | B2 | 12/2009 | Bar-Or |
| 2010/0048693 | A1 | 2/2010 | Geraci et al. |

FOREIGN PATENT DOCUMENTS

| EP | 0450991 A2 * | 2/1991 |
| EP | 0 450 991 | 10/1991 |
| EP | 1 014 993 B1 | 8/2002 |
| EP | 1 611 898 | 1/2006 |
| RU | 2 214 269 | 10/2003 |
| WO | 9639144 A1 | 12/1996 |
| WO | 03068187 | 8/2003 |
| WO | 2005047451 A2 | 5/2005 |
| WO | 2007035843 A2 | 3/2007 |
| WO | 2010028247 A2 | 3/2010 |

OTHER PUBLICATIONS

Translation of EP0450991A2. 1991.*
Anonymous "Emphysema Guide: Causes, Symptoms and Treatment Options" http://www.drugs.com/health-guide/emphysema.html. Published Dec. 23, 2010.*
Soskel et al. "Mechanisms of Lung Injury in the Copper-Deficient Hamster Model of Emphysema" Chest 85 Supplement:70S-73S. Published Jun. 1984.*
Lau and Sarkar "The interaction of copper(II) and glycyl-L-histidyl-L-lysine, a growth-modulating tripeptide from plasma" Biochem J. 199:649-656. Published 1981.*
Golpon et al., Am J Respir Cell Mol Biol. 31(6):595-600 (2004). "Emphysema lung tissue gene expression profiling."
Ning et al., Proc Natl Acad Sci U S A. 101(41):14895-14900 (2004). "Comprehensive gene expression profiles reveal pathways related to the pathogenesis of chronic obstructive pulmonary disease."
Bhattacharya et al., Am J Respir Cell Mol Biol. 40(3):359-67 (2009). "Molecular biomarkers for quantitative and discrete COPD phenotypes."
Spira et al., Am J Respir Cell Mol Biol. 31(6):601-10 (2004). "Gene expression profiling of human lung tissue from smokers with severe emphysema."
Wang et al., Am J Respir Crit Care Med. 177(4):402-11 (2008). "Gene expression profiling in patients with chronic obstructive pulmonary disease and lung cancer."

(Continued)

*Primary Examiner* — Christina Bradley
*Assistant Examiner* — Zachary J Miknis
(74) *Attorney, Agent, or Firm* — Nixon Peabody LLP

(57) ABSTRACT

The invention described herein relates to methods of treating emphysema and COPD with a GHK tripeptide. The invention further relates to methods of determining the state of the lungs using biomarkers described herein.

13 Claims, 13 Drawing Sheets

(56) References Cited

OTHER PUBLICATIONS

Zandvoort et al., Eur Respir J. 28(3):533-41 (2006). "Altered expression of the Smad signalling pathway: implications for COPD pathogenesis."
Gauldie et al., Proc Am Thorac Soc. 3(8):696-702 (2006). "Smad3 signaling involved in pulmonary fibrosis and emphysema."
Pons et al., Eur Respir J. 26(1):60-6 (2005). "Decreased macrophage release of TGF-beta and TIMP-1 in chronic obstructive pulmonary disease."
Arul et al., Life. Sci. 80(4):275-284 (2007). "A therapeutic approach for diabetic wound healing using biotinylated HK incorporated collagen matrices."
Pickart et al.,19(8):969-88 (2008). J Biomater Sci Polym Ed. "The human tri-peptide GHK and tissue remodeling."
Simeon et al., J Invest Dermatol. 115(6):962-8. "Expression of glycosaminoglycans and small proteoglycans in wounds: modulation by the tripeptide-copper complex glycyl-L-histidyl-L-lysine-Cu2+."
Marquart et al., J Clin Invest. 92(5):2368-76 (1993). "In vivo stimulation of connective tissue accumulation by the tripeptide-copper complex glycyl-L-histidyl-L-lysine-Cu2+ in rat experimental wounds."
Lamson et al., Altern Med Rev. 5(5):429-31 (2000). "The use of nebulized glutathione in the treatment of emphysema: a case report."
Dekhuijzen et al., Eur Respir J. 23(4):629-36 (2004). "Antioxidant properties of N-acetylcysteine: their relevance in relation to chronic obstructive pulmonary disease."
Konigshoff et al., Swiss Med Wkly. 139(39-40):554-563 (2009). "TGF-beta signaling in COPD: deciphering genetic and cellular susceptibilities for future therapeutic regimen."
Roberts et al., Nature 422(6928):130-1 (2003). "Medicine: Smoke signals for lung disease."
Springer et al., Biol Chem. 385(7):649-53. (2004). "SMAD-signaling in chronic obstructive pulmonary disease: transcriptional down-regulation of inhibitory SMAD 6 and 7 by cigarette smoke."
Demoor et al., Eur Respir J. 34(2):405-16 (2009). "Role of lymphotoxin-alpha in cigarette smoke-induced inflammation and lymphoid neogenesis."
Vassallo et al., Respir Res. 11:45-58 (2010). "Cigarette smoke promotes dendritic cell accumulation in COPD; a Lung Tissue Research Consortium study."
Gray et al.,Am J Respir Crit Care Med. 178(5):444-52 (2008). "Sputum proteomics in inflammatory and suppurative respiratory diseases."

* cited by examiner

1. Whole lungs were removed from patients with severe COPD and from donors, inflated with air, and rapidly frozen in liquid nitrogen vapor.

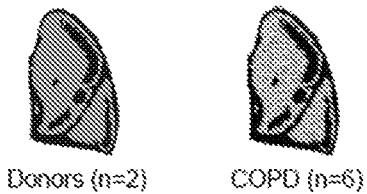

2. The frozen specimens were cut into 2 cm slices from apex to base of the lung.

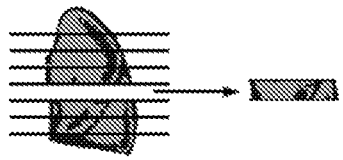

3. Adjacent tissue cores were removed from 8 different slices of each lung (8 patients x 8 slices = 64 total regions).

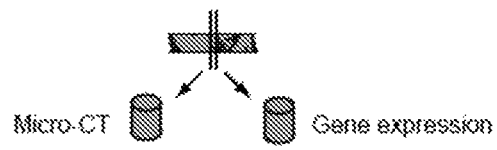

4. Micro-CT was used to measure Lm at 20 evenly spaced intervals throughout one core from each region.

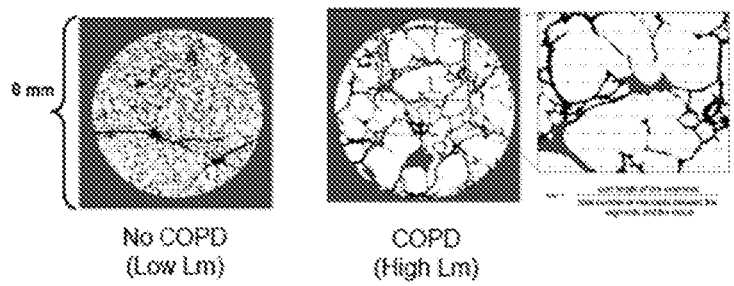

Figure 1

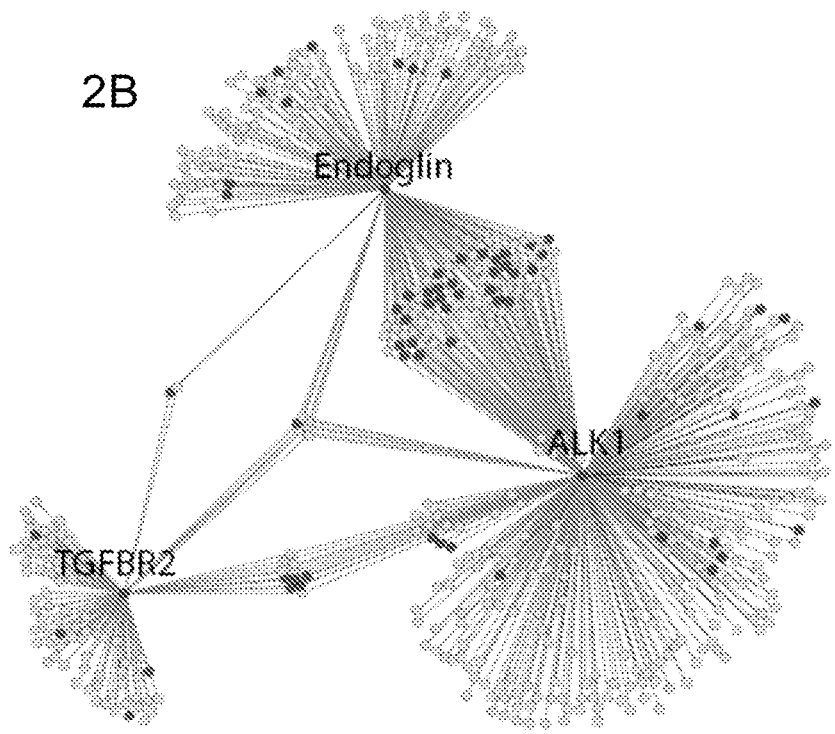
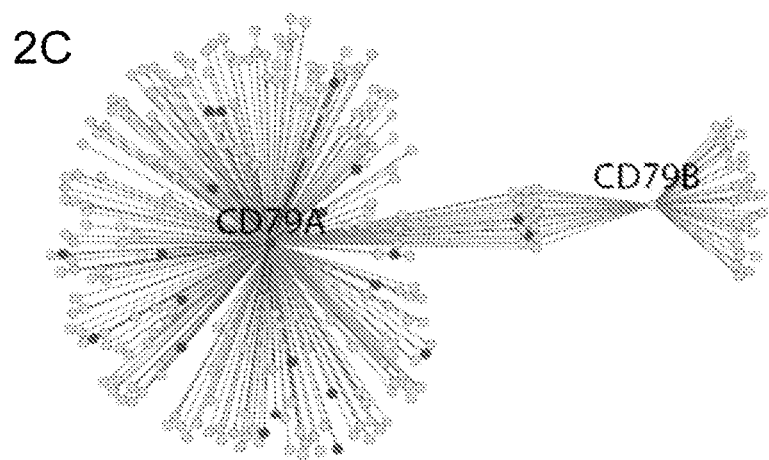
Figures 2A-2C cont

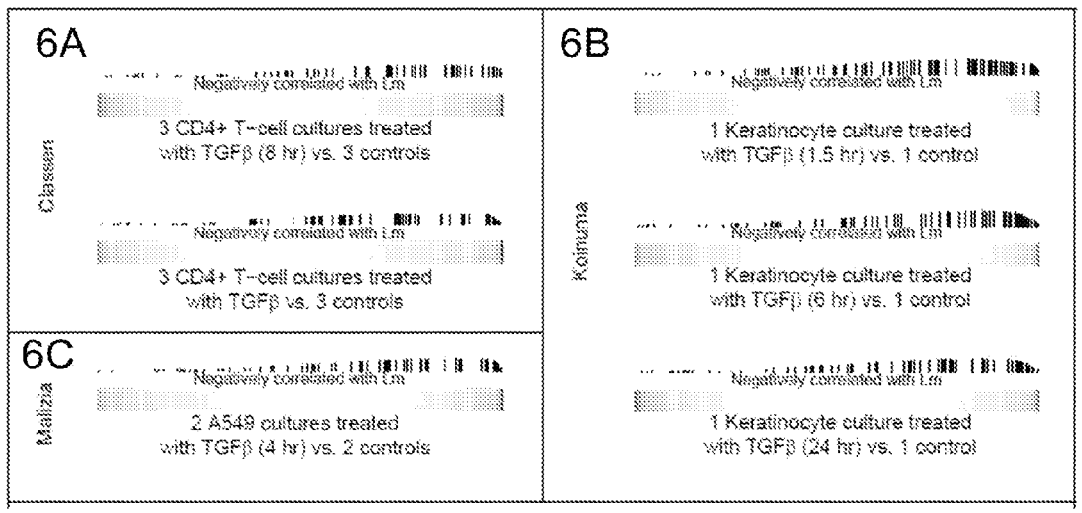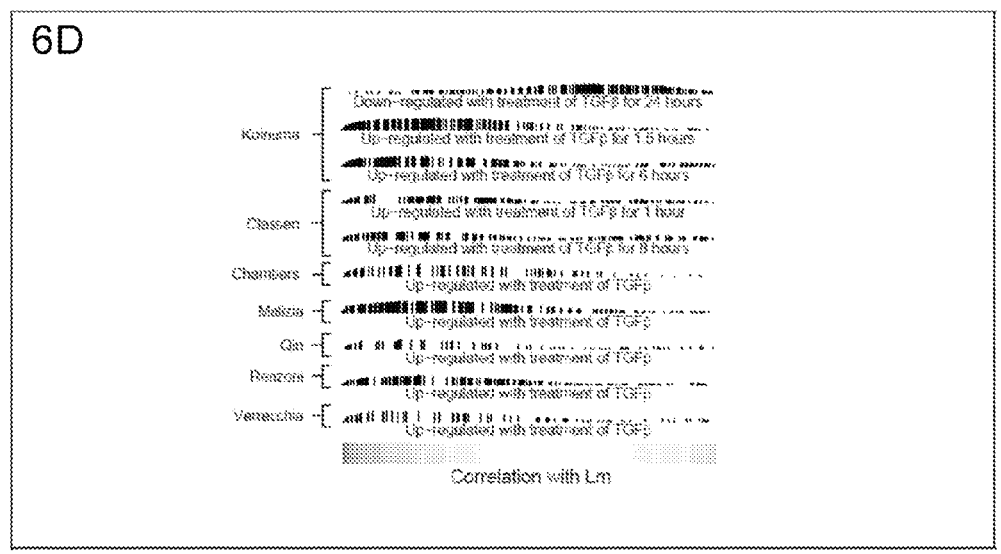
Figures 6A-6D

THERAPEUTIC AGENT FOR EMPHYSEMA AND COPD

CROSS REFERENCE TO RELATED APPLICATIONS

This application is a 35 U.S.C. §371 National Phase Entry Application of International Application No. PCT/US2012/029823, filed Mar. 20, 2012, which designates the United States, and which claims the benefit under 35 U.S.C. §119(e) of U.S. Provisional Patent Application Ser. No. 61/454,566 filed Mar. 20, 2011 and U.S. Provisional Patent Application Ser. No. 61/498,297 filed Jun. 17, 2011, the contents of each of which are herein incorporated by reference in their entireties.

GOVERNMENT SUPPORT

The present application was made with Government support under Grant Number R01 HL095388 awarded by the National Institutes of Health. The Government of the United States has certain rights in the invention.

FIELD OF THE INVENTION

The invention relates to methods of treating emphysema and COPD with the tripeptide GHK. The invention further relates to methods of detecting the presence and severity of emphysema using the expression level of marker genes.

SEQUENCE LISTING

The instant application contains a Sequence Listing which has been submitted in ASCII format via EFS-Web and is hereby incorporated by reference in its entirety. Said ASCII copy, created on Sep. 11, 2013, is named 701586-069653 SL and is 2,566,572 bytes in size.

BACKGROUND OF THE INVENTION

Chronic Obstructive Pulmonary Disease (COPD) is a worldwide public health problem and is the fourth leading cause of death in the United States (Heron et al., National Vital Statistics Reports 2009 57:1-134). COPD is characterized by irreversible airflow limitation due to obstruction in the small conducting airways and emphysematous destruction of the gas exchanging surface of the lung. Tobacco smoke is the major risk factor for COPD as 10-20% of smokers develop this disease (Fletcher and Peto British Medical Journal 1977 1:1645-8). Current theories concerning pathogenesis of COPD include an imbalance between protease and anti-protease activity, induced apoptosis of alveolar wall cells through deregulation of pathways involved in oxidative stress, angiogenesis, and chronic inflammation, and aberrant tissue remodeling and repair processes that lead to the destruction of the extra cellular matrix (ECM) in the lung. However, the etiology of the initiation and progression of COPD remain poorly understood.

Several groups have profiled gene expression in lung tissue from patients with and without COPD or between patients with varying levels of airflow obstruction in order to understand differences in gene expression related to COPD (Golpon et al., Am J Respir Cell Mol Biol 2004 31:595-600; Ning et al., PNAS 2004 101:14895-14900; Bhattacharya et al., Am J Respir Cell Mol Biol 2009 40:359-367; Spira et al., Am J Respir Cell Mol Biol 2004 31:601-610; Wang et al., Am J Respir Cell Mol Biol 2008 177:402-411). Although these studies have provided an initial look into the COPD transcriptome, their results have limited value in diagnosing COPD because they primarily relied on the use of lung function testing to define the presence or degree of COPD. Lung function testing cannot distinguish between obstruction in the small airways and emphysematous destruction of the lung parenchyma nor provide information about regional differences in disease severity.

Accordingly, a need exists for novel therapies for the treatment of emphysema and COPD as well as improved diagnostics for the presence and severity of emphysema in a subject.

SUMMARY OF THE INVENTION

Embodiments of the present invention are based on the discovery that as emphysematous destruction of lung tissue increases, the expression of certain genes relating to inflammatory processes is upregulated while the expression of certain genes associated with tissue remodeling and the TGF-β signaling pathway is downregulated. Another aspect relates to the discovery that the tripeptide Glycine-Histidine-Lysine (GHK) is capable of inducing the expression of the same genes which are normally downregulated during emphysematous destruction.

As described herein, the inventors have demonstrated that GHK is capable of upregulating a set of genes involved in tissue remodeling and the TGF-β signaling pathway which are down-regulated during the progression of emphysema. Accordingly, one embodiment provides a method for treating COPD or emphysema by administering a composition comprising the tripeptide GHK to a patient. In certain embodiments the compound further comprises a pharmaceutically acceptable carrier.

In certain embodiments, treating a patient having emphysema or COPD with GHK decreases an indicator, marker, symptom, or the severity of COPD or emphysema by at least 10%, e.g., by at least 20%, at least 30%, at least 50%, at least 75%, at least 100%, at least 200% or more as compared to the indicator, marker, symptom or the severity prior to treatment with GHK or as compared to patients not receiving treatment with GHK.

In certain embodiments, a composition comprising GHK is administered to the airspace of the lung of a patient. In certain embodiments, a composition comprising GHK is administered to the airspace of the lung. In certain embodiments, a composition comprising GHK is administered orally or nasally. In certain embodiments, a composition comprising GHK is administered using an inhaler or a nebulizer. In certain embodiments, the GHK is not complexed with copper.

In certain embodiments, a composition comprises a therapeutically effective dose of GHK. In certain embodiments, a composition comprising GHK is administered to a patient at least once. In certain embodiments, a composition comprising GHK is administered to a patient repeatedly, e.g. once a day, twice a day, every other day, once a week, every 2 weeks, once a month, etc.

In certain embodiments, GHK is used in the manufacture of a medicament for the treatment of emphysema or COPD. In certain embodiments, the medicament is administered to the airspace of the lung. In certain embodiments, the medicament is administered orally or nasally. In certain embodiments, the medicament is administered using an inhaler or a nebulizer. In certain embodiments, the GHK is not complexed with copper.

In certain embodiments, there is provided herein a method of enhancing lung tissue repair and/or healing by contacting the lung tissue of a subject with a GHK peptide. In certain embodiments the subject is a mammal. In further embodiments, the subject is a human. In certain embodiments the subject has or has been diagnosed with or is at risk of developing emphysema. In certain embodiments the subject has or has been diagnosed with or is at risk of developing COPD. In certain embodiments the method further comprises selecting a subject in need of reversal of emphysematous lung destruction prior to administering to the subject a composition comprising a GHK peptide. In certain embodiments, administering a composition comprising GHK to the subject reverses emphysematous lung destruction by at least 10%, e.g., by at least 20%, at least 30%, at least 50%, at least 75%, at least 100%, at least 200% or more as compared to lung tissue repair or healing prior to administration of the composition or as compared to lung tissue repair or healing in patients not receiving treatment with the composition. In certain embodiments, contacting the lung tissue of the patient with a composition comprising GHK increases the lung tissue repair or healing by at least 10%, e.g., by at least 20%, at least 30%, at least 50%, at least 75%, at least 100%, at least 200% or more as compared to lung tissue repair or healing prior to administration of the composition or as compared to lung tissue repair or healing in patients not receiving treatment with the composition.

In certain embodiments, there is provided herein a method of enhancing the repair of extracellular matrix in the lung tissue by contacting the lung tissue of a subject with a GHK peptide. In certain embodiments the subject is a mammal. In further embodiments, the subject is a human. In certain embodiments the subject has, has been diagnosed with, or is at risk of developing emphysema. In certain embodiments the subject has, has been diagnosed with, or is at risk of developing COPD. In certain embodiments the method further comprises selecting a subject in need of enhanced repair of extracellular matrix in the lung tissue prior to contacting the lung tissue of the subject with the composition. In certain embodiments, contacting the lung tissue of the patient with a composition comprising GHK increases the repair of the extracellular matrix by at least 10%, e.g., by at least 20%, at least 30%, at least 50%, at least 75%, at least 100%, at least 200% or more as compared to repair of the extracellular matrix prior to administration of the composition or as compared to repair of the extracellular matrix in patients not receiving treatment with the composition.

In certain embodiments, there is provided herein a method of increasing TGF-β signaling in the lung tissue by contacting the lung tissue of a subject with a GHK peptide. In certain embodiments the subject is a mammal. In further embodiments, the subject is a human. In certain embodiments the subject has, has been diagnosed with, or is at risk of developing emphysema. In certain embodiments the subject has, has been diagnosed with, or is at risk of developing COPD. In certain embodiments the method further comprises selecting a subject in need of increased TGF-β signaling in the lung tissue prior to contacting the lung tissue of the subject with the composition. In certain embodiments, contacting the lung tissue of the patient with a composition comprising GHK increases TGF-β signaling by at least 10%, e.g., by at least 20%, at least 30%, at least 50%, at least 75%, at least 100%, at least 200% or more as compared to TGF-β signaling prior to administration of the composition or as compared to TGF-(signaling in patients not receiving treatment with the composition.

In certain embodiments, there is provided herein an assay for assessing the lungs of a subject comprising; 1) transforming the expression product of at least two marker genes in a lung tissue sample obtained from a subject into detectable targets wherein the marker genes are selected from Table 1 and/or Table 2, 2) measuring the level of the detectable targets 3) comparing the level of the detectable targets in the lung tissue sample from a subject to reference levels of those detectable targets, wherein a statistically significant difference in expression levels of at least two detectable targets in the sample from the subject relative to the reference levels indicates the presence of emphysema. In certain embodiments, one or more of the marker genes of emphysematous damage are selected from the group consisting of ITGB1, NEDD9, ACVRL1, SMAD6 and TGFBR2.

In certain embodiments, the two or more marker genes of emphysematous damage are selected from Table 1 and/or Table 2. In certain embodiments, one or more of the marker genes of emphysematous damage are selected from the group consisting of ITGB1, NEDD9, ACVRL1, SMAD6 and TGFBR2. In certain embodiments, one or more of these marker genes can be used in the assays and systems described herein. In certain embodiments, one or more of these marker genes and one or more additional genes can be used in the assays and systems described herein.

In certain embodiments, the expression product of a marker gene is a mRNA. In certain embodiments, the expression product of a marker gene is a protein.

In certain embodiments, the assay described above identifies patients having severe emphysema. In certain embodiments, the assay described above identifies a patient in need of a treatment for emphysema. In certain embodiments, a subject indicated to have emphysema according to the assay described above is administered a GHK tripeptide.

In certain embodiments, there is provided herein a computer implemented system for detecting emphysema in a subject, the system comprising; a determination module configured to identify and detect the level of expression of at least two marker genes in a lung tissue sample obtained from a subject wherein the marker genes are selected from Table 1 and/or Table 2, a storage module configured to store output data from the determination module, a comparison module adapted to identify from the output data whether the level of expression of at least two maker genes in the lung tissue sample obtained from a subject varies by a statistically significant amount from the expression level found in a reference sample and a display module for displaying whether two or more marker genes have a statistically significant variation in expression level in the lung tissue sample obtained from a subject as compared to the reference expression level and/or displaying the relative expression levels of the marker genes. In certain embodiments, if the computing module determines that the level of expression of at least two marker genes in the lung tissue sample obtained from a subject varies by a statistically significant amount as compared to the level of expression the in the reference sample, the display module displays a signal indicating the increased expression level in the sample obtained from a subject. In further embodiments, the signal indicates that the subject has an increased likelihood of having emphysema. In certain embodiments, one or more of the marker genes of emphysematous damage are selected from the group consisting of ITGB1, NEDD9, ACVRL1, SMAD6 and TGFBR2.

In certain embodiments, the computer-implemented system displays a signal indicating that the expression levels in the sample obtained from a subject vary from those of the reference expression level. In certain embodiments, the computer-implemented system displays a signal indicating that the subject has an increased likelihood of having emphysema. In certain embodiments, the computer-implemented system displays a signal indicating that the subject is in need of treatment for emphysema. In certain embodiments, the computer-implemented system displays a signal indicating the degree to which the expression levels in the sample obtained from a subject vary from those of the reference expression level. In certain embodiments, the computer-implemented system displays a signal indicating that the subject has an increased likelihood of having a more severe case of emphysema.

The details of various embodiments of the invention are set forth in the description below. Other features, objects, and advantages of the invention will be apparent from the description and the drawings, and from the claims.

DESCRIPTION OF THE DRAWINGS

FIG. 1 is an illustrated overview of the study design.

FIG. 3A shows that genes associated with Lm are enriched among the genes associated with emphysema or α-1 antitrypsin deficiency (Goplon et al., American journal of respiratory cell and molecular biology 2004 31:595-600). T-statistic was calculated by a t-test between cases and controls. FIG. 3B shows that genes associated with Lm are enriched among the genes associated with diffusion capacity for carbon monoxide (DLCO) and forced expiratory volume at 1 sec (FEV1) (Spica et al American journal of respiratory cell and molecular biology 2004 31: 601-10), both of which are pulmonary phenotypic expressions of COPD. T-statistics were calculated by correlations of gene expression with a continuous variable. FIG. 3C shows that genes associated with Lm are enriched among the genes associated with DLCO, FEV1, FEV1/FVC (FVC=forced vital capacity), GOLD2 level emphysema, and GOLD3 level emphysema (Wang, L.-M. et al. American journal of respiratory and critical care medicine 2008 177:402-11). T-statistics for DLCO, FEV1 and FEV1/FVC were calculated by Pearson correlation. T-statistics between COPD cases and never-smoked controls were calculated using a t-test. FIG. 3D shows that genes associated with Lm are enriched among the genes associated with FEV1/FVC, FEV1, and COPD diagnosis (Bhattacharya et al., American journal of respiratory cell and molecular biology 2009 40:359-67). T-statistics for FEV1 and FEV1/FVC were calculated by Pearson correlation. T-statistics between cases and controls were calculated using a t-test. FIG. 3E shows that genes previously found to be associated with COPD-related clinical variables are enriched among the genes associated with Lm. T-statistic was calculated by correlations of gene expression with Lm using mixed-effect linear models.

FIGS. 6A-6D depict the relationship between gene expression changes associated with regional emphysema severity (Lm) and studies of TGFβ-related gene expression using GSEA. The vertical lines represent the position of genes associated with regional emphysema severity in the ranked gene list. The height of the vertical lines corresponds to the magnitude of the running enrichment score from GSEA. Enrichments with an FDR q-value <0.05 were considered significant.

FIG. 6A shows that genes associated with Lm are enriched among genes induced by TGFβ in Classen et al (Journal of immunology 2007 178:6931-40). FIG. 6B shows that genes associated with Lm are enriched among genes induced by TGFβ in Koinuma et al (Molecular and cellular biology 2009 29:172-86). FIG. 6C demonstrates that genes associated with Lm are enriched among genes induced by TGFβ in Malizia et al., (American journal of physiology. Lung cellular and molecular physiology 2008 295:L451-60). In FIGS. 6A-6C, the gradated bar represents the fold change between treated and untreated samples. FIG. 6D shows that genes most induced by TGFβ in seven studies are enriched among the genes that are associated with Lm. T-statistic was calculated by correlations of gene expression with Lm using mixed-effect linear models.

FIG. 7A shows that genes whose expression levels increase in response to treatment with GHK or TGFβ are enriched among genes that decrease with increasing emphysema severity. The gradated bar represents the T-statistics from correlations of gene expression with Lm using mixed-effect linear models. In FIGS. 7B-7D, the gradated bar represents the fold changes between treated and untreated samples.

FIG. 7B shows that genes which are differentially expressed in response to GHK in the CMap or to TGFβ treatment are enriched among genes that are differentially expressed in response to 0.1 nM GHK in fibroblast cell lines. FIG. 7C demonstrates that genes which are differentially expressed with TGFβ treatment or that are down-regulated with increasing emphysema severity are enriched among genes that are differentially expressed in response to 10 nM GHK in fibroblast cell lines. FIG. 7D demonstrates that genes which are differentially expressed in response to GHK are enriched among genes that are differentially expressed in response to TGFβ treatment in fibroblast cell lines.

FIG. 8A depicts the quantification of β1-integrin protein levels, demonstrating an increase after treatment of HLF-1 cells with GHK at 0.1 or 10 nM (p<0.01), treatment with TGFβ at 10 ng/mL (p<0.05) and treatment with GHK at 0.1 nM or 10 nM in combination with TGFβ (p<0.001) compared to vehicle (DMSO) treated controls. FIG. 8B is an immunoblot of one of the three replicates of FIG. 8A.

DETAILED DESCRIPTION OF THE INVENTION

Figures 2A, 2B, 2C:
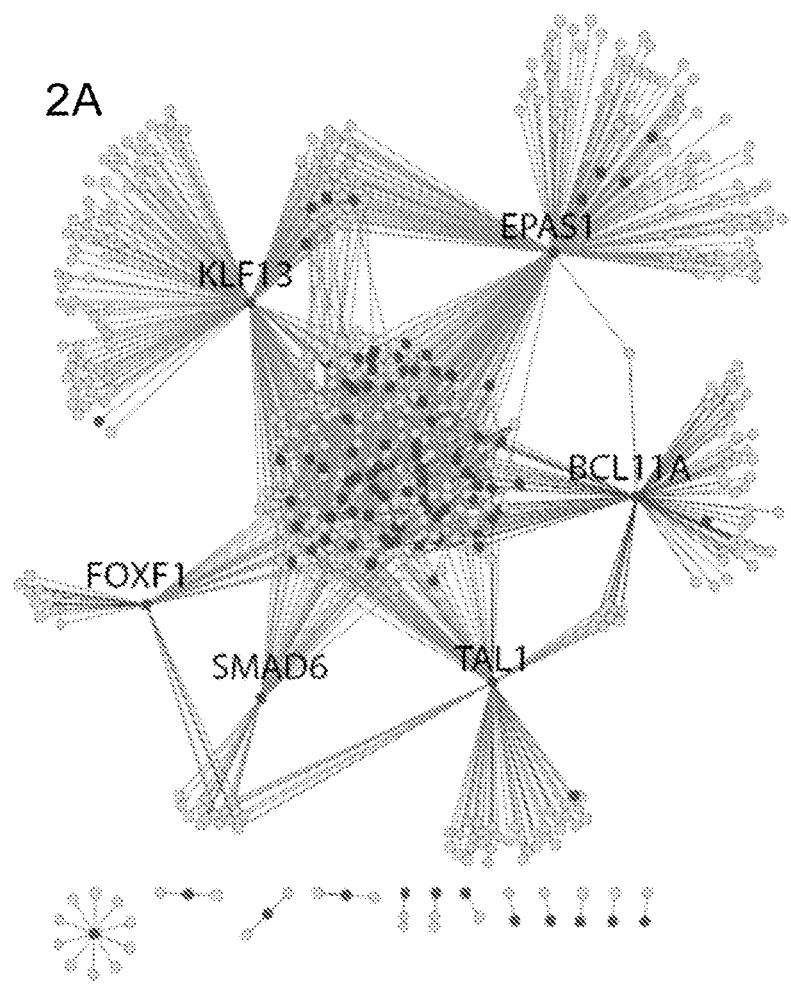
FIGS. 2A-2C depict maps of gene expression relevance networks. Dark blue circles indicate genes that have expression positively correlated with Lm while circles with white centers indicate all other genes. Edges are indicated by lighter (positive correlation) or darker (negative correlation) lines.

One aspect of the invention relates to a method of using a GHK tripeptide to treat emphysema or to treat COPD and/or to reverse emphysematous lung damage in a subject.

Another aspect of the invention relates to a method of detecting the presence of emphysema in a subject or determining if a subject is in need of treatment for emphysema by measuring the expression level of at least two marker genes selected from the group consisting of ITGB1, NEDD9, ACVRL1, SMAD6, TGFBR2 and the genes listed in Table 1 and Table 2, and comparing those expression levels to the expression levels found in a reference sample. Another aspect of the invention relates to a method of detecting the severity of emphysema in a subject or determining if a subject is in need of treatment for emphysema by measuring the expression level of at least two marker genes selected from the group consisting of ITGB1, NEDD9, ACVRL1, SMAD6, TGFBR2 and the genes listed in Table 1 and Table 2, and comparing those expression levels to the expression levels found in a reference sample. Also provided herein is a computer system for performing the measurement and comparison of these expression levels.

DEFINITIONS

For convenience, the meaning of certain terms and phrases used in the specification, examples, and appended claims, are provided below. If there is an apparent discrepancy between the usage of a term in the art and its definition provided herein, the definition provided within the specification shall prevail.

Definitions of common terms in cell biology and molecular biology can be found in "The Merck Manual of Diagnosis and Therapy", 18th Edition, published by Merck Research Laboratories, 2006 (ISBN 0-911910-18-2); Robert S. Porter et al. (eds.), The Encyclopedia of Molecular Biology, published by Blackwell Science Ltd., 1994 (ISBN 0-632-02182-9); and Robert A. Meyers (ed.), Molecular Biology and Biotechnology: a Comprehensive Desk Reference, published by VCH Publishers, Inc., 1995 (ISBN 1-56081-569-8); The ELISA guidebook (Methods in molecular biology 149) by Crowther J. R. (2000); Fundamentals of RIA and Other Ligand Assays by Jeffrey Travis, 1979, Scientific Newsletters; Immunology by Werner Luttmann, published by Elsevier, 2006. Definitions of common terms in molecular biology are also be found in Benjamin Lewin, Genes IX, published by Jones & Bartlett Publishing, 2007 (ISBN-13: 9780763740634); Kendrew et al. (eds.), Biology and Biotechnology: a Comprehensive Desk Reference, published by VCH Publishers, Inc., 1995 (ISBN 1-56081-569-8) and Current Protocols in Protein Sciences 2009, Wiley Intersciences, Coligan et al., eds.

Unless otherwise stated, the present invention was performed using standard procedures, as described, for example in Methods in Enzymology, Volume 289: Solid-Phase Peptide Synthesis, J. N. Abelson, M. I. Simon, G. B. Fields (Editors), Academic Press; 1st edition (1997) (ISBN-13: 978-0121821906); U.S. Pat. Nos. 4,965,343, and 5,849,954; Maniatis et al., Molecular Cloning: A Laboratory Manual, Cold Spring Harbor Laboratory Press, Cold Spring Harbor, N.Y., USA (1982); Sambrook et al., Molecular Cloning: A Laboratory Manual (2 ed.), Cold Spring Harbor Laboratory Press, Cold Spring Harbor, N.Y., USA (1989); Davis et al., Basic Methods in Molecular Biology, Elsevier Science Publishing, Inc., New York, USA (1986); or Methods in Enzymology: Guide to Molecular Cloning Techniques Vol. 152, S. L. Berger and A. R. Kimmerl Eds., Academic Press Inc., San Diego, USA (1987); Current Protocols in Protein Science (CPPS) (John E. Coligan, et. al., ed., John Wiley and Sons, Inc.), Current Protocols in Cell Biology (CPCB) (Juan S. Bonifacino et. al. ed., John Wiley and Sons, Inc.), and Culture of Animal Cells: A Manual of Basic Technique by R. Ian Freshney, Publisher: Wiley-Liss; 5th edition (2005), Animal Cell Culture Methods (Methods in Cell Biology, Vol. 57, Jennie P. Mather and David Barnes editors, Academic Press, 1st edition, 1998) which are all incorporated by reference herein in their entireties.

The terms "decrease", "reduced", "reduction", "decrease" or "inhibit" are all used herein generally to mean a decrease by a statistically significant amount. However, for avoidance of doubt, "reduced", "reduction" or "decrease" or "inhibit" means a decrease by at least 10% as compared to a reference level, for example a decrease by at least about 20%, or at least about 30%, or at least about 40%, or at least about 50%, or at least about 60%, or at least about 70%, or at least about 80%, or at least about 90% or up to and including a 100% decrease (e.g. absent level or non-detectable level as compared to a reference sample), or any decrease between 10-100% as compared to a reference level. In the context of a disease marker or symptom is meant a statistically significant decrease in such level. The decrease can be, for example, at least 10%, at least 20%, at least 30%, at least 40% or more, and is preferably down to a level accepted as within the range of normal for an individual without such disorder.

The terms "increased", "increase" or "enhance" or "activate" are all used herein to generally mean an increase by a statically significant amount; for the avoidance of any doubt, the terms "increased", "increase" or "enhance" or "activate" means an increase of at least 10% as compared to a reference level, for example an increase of at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, or at least about a 2-fold, or at least about a 3-fold, or at least about a 4-fold, or at least about a 5-fold or at least about a 10-fold increase, or any increase between 2-fold and 10-fold or greater as compared to a reference level.

As used herein, the term "administer" refers to the placement of a composition into a subject by a method or route which results in at least partial localization of the composition at a desired site such that desired effect is produced. A compound or composition described herein can be administered by any appropriate route known in the art including, but not limited to, oral or parenteral routes, including intravenous, intramuscular, subcutaneous, transdermal, airway (aerosol), pulmonary, nasal, rectal, and topical (including buccal and sublingual) administration.

Exemplary modes of administration include, but are not limited to, injection, infusion, instillation, inhalation, or ingestion. "Injection" includes, without limitation, intravenous, intramuscular, intraarterial, intrathecal, intraventricular, intracapsular, intraorbital, intrathecal, intradermal, intraperitoneal, transtracheal, subcutaneous, subcuticular, intraarticular, sub capsular, subarachnoid, intraspinal, intracerebrospinal, and intrasternal injection and infusion. In preferred embodiments, the compositions are administered by intravenous infusion or injection.

As used herein in the context of expression, the terms "treat," "treatment," and the like, refer to a decrease in severity, indicators, symptoms, markers of COPD or emphysema as described herein. In the context of the present invention insofar as it relates to any of the conditions recited herein, the terms "treat," "treatment," and the like mean to relieve, alleviate, ameliorate, inhibit, slow down, reverse, or stop the progression, aggravation, deterioration, progression, anticipated progression or severity of at least one symptom or complication associated with COPD or emphysema. In one embodiment, the symptoms of COPD or emphysema are alleviated by at least 5%, at least 10%, at least 20%, at least 30%, at least 40%, or at least 50%.

As used herein, the phrase "therapeutically effective amount", "effective amount" or "effective dose" refers to an amount that provides a therapeutic benefit in the treatment, prevention, or management of COPD or emphysema, e.g. an amount that provides a statistically significant decrease in at least one symptom of COPD or emphysema. Determination of a therapeutically effective amount is well within the capability of those skilled in the art. Generally, a therapeutically effective amount can vary with the subject's history, age, condition, sex, as well as the severity and type of the medical condition in the subject, and administration of other pharmaceutically active agents.

As used herein, the term "pharmaceutical composition" refers to the active agent in combination with a pharmaceutically acceptable carrier of chemicals and compounds commonly used in the pharmaceutical industry. The term "pharmaceutically acceptable carrier" excludes tissue culture medium.

The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

The phrase "pharmaceutically acceptable carrier" as used herein means a pharmaceutically acceptable material, composition or vehicle, such as a liquid or solid filler, diluent, excipient, solvent or encapsulating material, involved in carrying or transporting the subject agents from one organ, or portion of the body, to another organ, or portion of the body. Each carrier must be "acceptable" in the sense of being compatible with the other ingredients of the formulation, for example the carrier does not decrease the impact of the agent on the treatment. In other words, a carrier is pharmaceutically inert.

As used herein, a "subject" means a human or animal. Usually the animal is a vertebrate such as a primate, rodent, domestic animal or game animal. Primates include chimpanzees, cynomologous monkeys, spider monkeys, and macaques, e.g., Rhesus. Rodents include mice, rats, woodchucks, ferrets, rabbits and hamsters. Domestic and game animals include cows, horses, pigs, deer, bison, buffalo, feline species, e.g., domestic cat, canine species, e.g., dog, fox, wolf, avian species, e.g., chicken, emu, ostrich, and fish, e.g., trout, catfish and salmon. Patient or subject includes any subset of the foregoing, e.g., all of the above, but excluding one or more groups or species such as humans, primates or rodents. In certain embodiments, the subject is a mammal, e.g., a primate, e.g., a human. The terms, "patient", "individual" and "subject" are used interchangeably herein.

Preferably, the subject is a mammal. The mammal can be a human, non-human primate, mouse, rat, dog, cat, horse, or cow, but are not limited to these examples. Mammals other than humans can be advantageously used, for example, as subjects that represent animal models of COPD or emphysema. In addition, the methods described herein can be used to treat domesticated animals and/or pets. A subject can be male or female. A subject can be one who has been previously diagnosed with or identified as suffering from or having COPD or emphysema or one or more complications related to COPD or emphysema, and optionally, but need not have already undergone treatment for COPD or emphysema or the one or more complications related to COPD or emphysema. A subject can also be one who is not suffering from COPD or emphysema. A subject can also be one who has been diagnosed as having a strong likelihood of developing or identified as suffering from COPD or emphysema or one or more complications related to COPD or emphysema. It can include one who shows improvements in known COPD or emphysema risk factors as a result of receiving one or more treatments for COPD or emphysema or one or more complications related to COPD or emphysema. Alternatively, a subject can also be one who has not been previously diagnosed as having COPD or emphysema or one or more complications related to COPD or emphysema. For example, a subject can be one who exhibits one or more risk factors for COPD or emphysema or one or more complications related to COPD or emphysema, or a subject who does not exhibit COPD or emphysema risk factors, or a subject who is asymptomatic for COPD or emphysema or one or more complications related to COPD or emphysema. A subject can also be one who is suffering from or at risk of developing COPD or emphysema or one or more complications related to COPD or emphysema. A subject can also be one who has been diagnosed with or identified as having one or more complications related to COPD or emphysema, or alternatively, a subject can be one who has not been previously diagnosed with or identified as having one or more complications related to COPD.

As used herein, the term "emphysematous lung damage" or "emphysematous lung destruction" refers to the degradation of the lung parenchyma and alveoli characteristic of emphysema and COPD. This destruction decreases or destroys the ability of the affected lung tissue to perform gas exchange. Emphysematous lung damage can be measured by mean linear intercept (Lm) as described herein.

The terms "respiratory disorder" and "respiratory disease" are used interchangeably herein and refer to any condition and/or disorder relating to respiration and/or the respiratory system. The respiratory disorder can be allergic or non-allergic. In some embodiments, the respiratory disorder is selected from the group consisting of asthma, atopic asthma, non-atopic asthma, emphysema, bronchitis, chronic obstructive pulmonary disease (COPD), sinusitis, allergic rhinitis. In some embodiments, the respiratory disorder is characterized by increased responsiveness of the tracheas and bronchi to various stimuli, i.e., allergens, resulting in a widespread narrowing of the airways.

The term "COPD" is generally applied to chronic respiratory disease processes characterized by the persistent obstruction of bronchial air flow. COPD patients can suffer from conditions such as bronchitis, cystic fibrosis, asthma or emphysema.

The term "asthma" as used herein is defined as a disease of the airways that is characterized by increased responsiveness of the tracheobronchial tree to a multiplicity of stimuli.

The term "allergic respiratory disorder" or "hypersensitivity disease" refers to allergic diseases and/or disorders of the lungs or respiratory system. Allergic disorders are characterized by hypersensitivity to an allergen.

The term "allergen" as used herein refers to an innocuous antigen that induces an allergic or hypersensitive reaction.

The term "non-allergic" as used herein refers to a respiratory disorder that is not a result from or caused by an allergen. Thus, the non-allergic respiratory disorder is caused by other mechanisms not relating to hypersensitivity to air innocuous agent or allergen.

The term "computer" can refer to any non-human apparatus that is capable of accepting a structured input, processing the structured input according to prescribed rules, and producing results of the processing as output. Examples of a computer include: a computer; a general purpose computer; a supercomputer; a mainframe; a super mini-computer; a mini-computer; a workstation; a micro-computer; a server; an interactive television; a hybrid combination of a computer and an interactive television; and application-specific hardware to emulate a computer and/or software. A computer can have a single processor or multiple processors, which can operate in parallel and/or not in parallel. A computer also refers to two or more computers connected together via a network for transmitting or receiving information between the computers. An example of such a computer includes a distributed computer system for processing information via computers linked by a network.

The term "computer-readable medium" may refer to any storage device used for storing data accessible by a computer, as well as any other means for providing access to data by a computer. Examples of a storage-device-type computer-readable medium include: a magnetic hard disk; a floppy disk; an optical disk, such as a CD-ROM and a DVD; a magnetic tape; a memory chip.

The term "software" is used interchangeably herein with "program" and refers to prescribed rules to operate a computer. Examples of software include: software; code segments; instructions; computer programs; and programmed logic.

The term a "computer system" may refer to a system having a computer, where the computer comprises a computer-readable medium embodying software to operate the computer.

The term "statistically significant" or "significantly" refers to a standard definition of statistical significance and generally means a two standard deviation (2SD) below normal, or lower, concentration of the marker. The term refers to statistical evidence that there is a difference. It is defined as the probability of making a decision to reject the null hypothesis when the null hypothesis is actually true. The decision is often made using the p-value.

The terms "t-statistic" and "t-stat" are used herein interchangeably. As used herein it can a test of statistical significance which uses a formula from which at value is derived. The value is then compared with a set of t-distribution tables to see whether the null hypothesis should be rejected or not.

Other than in the operating examples, or where otherwise indicated, all numbers expressing quantities of ingredients or reaction conditions used herein should be understood as modified in all instances by the term "about." The term "about" when used in connection with percentages can mean±1%.

The singular terms "a," "an," and the include plural referents unless context clearly indicates otherwise. Similarly, the word or is intended to include and unless the context clearly indicates otherwise. Although methods and materials similar or equivalent to those described herein can be used in the practice or testing of this disclosure, suitable methods and materials are described below. The abbreviation, "e.g." is derived from the Latin exempli gratia, and is used herein to indicate a non-limiting example. Thus, the abbreviation "e.g." is synonymous with the term "for example."

All patents and other publications identified are expressly incorporated herein by reference for the purpose of describing and disclosing, for example, the methodologies described in such publications that might be used in connection with the present invention. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

Treatment of COPD and/or Emphysema

COPD

Certain aspects of the invention provided herein relate to methods of treating COPD in a subject. COPD can be characterized as a destruction of both small airways and parenchyma resulting in a progressive impairment in pulmonary function. The disease may be divided into two subgroups, namely chronic bronchitis and emphysema. Chronic bronchitis is characterized by mucus hypersecretion from the conducting airways, inflammation and eventual scarring of the bronchi (airway tubes). Many persons with COPD have a component of both of these conditions.

The interaction between parenchymal disease and the vasculature is often clinically evident by the observation that patients with severe COPD have mild or moderate pulmonary hypertension at rest. Histopathologically and microscopically, the pulmonary vasculature in COPD is typically characterized by initial thickening with smooth muscle deposition as well as a loss of both alveolar septal structures and microvasculature. Furthermore, in COPD it has been observed that both alveolar septal and endothelial cells undergo apoptosis.

The presenting symptoms for COPD are typically breathlessness accompanied by a decline in FEV1 (i.e., forced expiratory volume in 1 second). COPD patients have difficulty breathing because they develop smaller, inflamed air passageways and have partially destroyed alveoli. Chronic bronchitis can also be diagnosed by asking the patient whether they have a "productive cough," i.e. one that yields sputum. The patients' symptoms are cough and expectoration of sputum. Chronic bronchitis can lead to more frequent and severe respiratory infections, narrowing and plugging of the bronchi, difficult breathing and disability.

COPD patients are traditionally treated with bronchodilators and/or steroids and evaluated by spirometry for the presence of airflow obstruction and reversibility. If airflow obstruction is present and reversibility less than 15%, particularly in a smoker, then they are often diagnosed as having COPD.

Emphysema

Certain aspects of the invention provided herein relate to methods of treating emphysema in a subject and/or to assessing the severity of emphysemas in a patient. Emphysema is a chronic lung disease which affects the alveoli and/or the ends of the smallest bronchi. The condition is characterized by destructive changes and enlargement of the alveoli (air sacs) within the lungs. The lung loses its elasticity and therefore these areas of the lungs become enlarged. These enlarged areas trap stale air and do not effectively exchange it with fresh air. This results in difficult breathing and may result in insufficient oxygen being delivered to the blood. The predominant symptom in patients with emphysema is shortness of breath.

GHK

Certain aspects of the invention provided herein relate to methods of treating emphysema and/or COPD in a subject by administering to the subject a GHK tripeptide. GHK is comprised of a Glycine-Histidine-Lysine tripeptide. GHK may be synthesized by methods familiar to those skilled in the art or purchased commercially (#CG51068 RayBiotech, Inc. Norcross, Ga.).

Variations and modifications to GHK peptide to provide means for targeting. For example, GHK can be linked with a molecular counter-ligand, for example but not limited to, molecules which target the lung epithelium, to make GHK tissue specific.

In one embodiment, GHK is linked to a carrier to enhance its bioavailability. Such carriers are known in the art and include poly (alkyl) glycol such as poly ethylene glycol (PEG) or methoxypolyethylene glycol (mPEG) which can increase the in vivo half life of proteins to which they are conjugated. Methods of PEGylation of a peptide are well known by one of ordinary skill in the art, and are considerations of, for example, how large a PEG polymer to use. In some embodiments, a peptide can be fused to serum albumin to increase the serum half-life of therapeutic polypeptides and peptides.

It will be appreciated that the GHK peptide useful in the methods and composition as disclosed herein can optionally contain amino acids other than the 20 amino acids commonly referred to as the 20 naturally occurring amino acids.

In some embodiments, any of the amino acids of the GHK peptide, including the terminal amino acids, can be modified either by natural processes such as glycosylation and other posttranslational modifications, or by chemical modification techniques which are well known in the art. Even the common modifications that occur naturally in polypeptides are too numerous to list exhaustively here, but they are well described in basic texts and in more detailed monographs, as well as in a voluminous research literature, and they are well known to those of skill in the art. Among the known modifications which can be present in polypeptides of the present invention are, to name an illustrative few, acetylation, acylation, ADP-ribosylation, amidation, covalent attachment of flavin, covalent attachment of a heme moiety, covalent attachment of a polynucleotide or polynucleotide derivative, covalent attachment of a lipid or lipid derivative, covalent attachment of phosphotidylinositol, cross-linking, cyclization, disulfide bond formation, demethylation, formation of covalent cross-links, formation of cysteine, formation of pyroglutamate, formylation, gamma-carboxylation, glycation, glycosylation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such modifications are well known to those of skill and have been described in great detail in the scientific literature. Several particularly common modifications, glycosylation, lipid attachment, sulfation, gamma-carboxylation of glutamic acid residues, hydroxylation and ADP-ribosylation, for instance, are described in most basic texts, such as, for instance, 1. E. Creighton, Proteins-Structure and Molecular Properties, 2nd Ed., W.H. Freeman and Company, New York, 1993. Many detailed reviews are available on this subject, such as, for example, those provided by Wold, F., in Posttranslational Covalent Modification of Proteins, B. C. Johnson, Ed., Academic Press, New York, pp 1-12, 1983; Sifter et al., Meth. Enzymol. 182: 626-646, 1990 and Rattan et al., Protein Synthesis: Posttranslational Modifications and Aging, Ann. N.Y. Acad. Sci. 663: 48-62, 1992.

It will also be appreciated, as is well known and as noted above, that peptides and polypeptides are not always entirely linear. For instance, polypeptides can be branched as a result of ubiquitination, and they can be circular, with or without branching, generally as a result of posttranslational events, including natural processing events and events brought about by human manipulation which do not occur naturally. Circular, branched and branched circular polypeptides can be synthesized by non translational natural processes and by entirely synthetic methods.

Modifications can occur anywhere in a polypeptide, including the peptide backbone, the amino acid side-chains and the amino or carboxyl termini. In fact, blockage of the amino or carboxyl group in a polypeptide, or both, by a covalent modification, is common in naturally occurring and; synthetic polypeptides and such modifications can be present in polypeptides of the present invention, as well. For instance, the amino terminal residue of polypeptides made in *E. coli*, prior to proteolytic processing, almost invariably will be N-formylmethionine.

The modifications that occur in a polypeptide often will be a function of how it is made. For polypeptides made by expressing a cloned gene in a host, for instance, the nature and extent of the modifications in large part will be determined by the host cell posttranslational modification capacity and the modification signals present in the polypeptide amino acid sequence. For instance, as is well known, glycosylation often does not occur in bacterial hosts such as *E. coli*. Accordingly, when glycosylation is desired, a polypeptide should be expressed in a glycosylation host, generally a eukaryotic cell. Insect cells often carry out the same posttranslational glycosylation as mammalian cells and, for this reason, insect cell expression systems have been developed to efficiently express mammalian proteins having native patterns of glycosylation, inter alia. Similar considerations apply to other modifications.

It will be appreciated that the same type of modification can be present to the same or varying degree at several sites in a given polypeptide. Also, a given peptide or polypeptide can contain many types of modifications.

In some embodiments, N-methyl and hydroxy-amino acids can be substituted for conventional amino acids in solid phase peptide synthesis. However, production of polymers with reduced peptide bonds requires synthesis of the dimmer of amino acids containing the reduced peptide bond. Such dimers are incorporated into polymers using standard solid phase synthesis procedures. Other synthesis procedures are well known in the art.

Accordingly, functional derivatives of the GHK peptide may be prepared by modification of the amino acids of GHK peptide are encompassed for use in the methods and compositions as disclosed herein. Modifications may occur anywhere in the GHK peptide sequence or its functional derivative polypeptide, including the peptide backbone, the amino acid side-chains and the amino or carboxyl termini. Modifications may include, for example, acetylation, acylation, ADP-ribosylation, amidation, covalent attachment of other functional moiety, covalent attachment of a lipid or lipid derivative, covalent attachment of phosphotidylinositol, cross-linking, cyclization, disulfide bond formation, demethylation, formation of covalent cross-links, formylation, gamma-carboxylation, glycosylation, glycophosphatidylinositol (GPI) anchor formation, hydroxylation, iodination, methylation, myristoylation, oxidation, pegylation, proteolytic processing, phosphorylation, prenylation, racemization, selenoylation, sulfation, transfer-RNA mediated addition of amino acids to proteins such as arginylation, and ubiquitination. See, for instance, E. Creighton Proteins-Structure and Molecular Properties, 2nd Ed., W. H. Freeman and Company, New York (1993); B. C. Johnson, Post Translational Covalent Modification of Proteins, Academic Press, New York, (1983); Seifter et al., Meth. Enzymol. 182: 626-646 (1990); Rattan et al., Ann. N.Y. Acad. Sci. 663: 48-62 (1992). Preparation of these modified derivatives may, for example, be useful if direct administration of the GHK peptide is contemplated.

In some embodiments the GHK peptide can be conjugated to a second entity, for example, to promote stability or for specific cell type targeting. In some embodiments, a GHK peptide or fragments, derivatives or variants thereof can be conjugated to a first fusion partner (i.e. IgG1 Fc). The conjugation can be a non-covalent or covalent interaction, for example, by means of chemical crosslinkage or conjugation. As discussed herein, in some embodiments, the GHK peptide is fused to serum albumin to increase the serum half-life of the GHK peptide.

In some embodiments, the GHK peptide can also be fused to a second fusion partner, for example, to a polypeptide that targets the product to a desired location, or, for example, a tag that facilitates its purification, if so desired. Tags and fusion partners can be designed to be cleavable, if so desired. Another modification specifically contemplated is attachment, e.g., covalent attachment, to a polymer. In one aspect, polymers such as polyethylene glycol (PEG) or methoxy-polyethylene glycol (mPEG) can increase the in vivo half-life of proteins to which they are conjugated. Methods of PEGylation of polypeptide agents are well known to those skilled in the art, as are considerations of, for example, how large a PEG polymer to use.

As used herein, the term "conjugate" or "conjugation" refers to the attachment of two or more entities to form one entity. For example, the methods of the present invention provide conjugation of a GHK peptide or fragments, derivatives or variants thereof joined with another entity, for example a moiety such as a first fusion partner that makes the GHK peptide stable, such as Ig carrier particle, for example IgG1 Fc. The attachment can be by means of linkers, chemical modification, peptide linkers, chemical linkers, covalent or non-covalent bonds, or protein fusion or by any means known to one skilled in the art. The joining can be permanent or reversible. In some embodiments, several linkers can be included in order to take advantage of desired properties of each linker and each protein in the conjugate. Flexible linkers and linkers that increase the solubility of the conjugates are contemplated for use alone or with other linkers as disclosed herein. Peptide linkers can be linked by expressing DNA encoding the linker to one or more proteins in the conjugate. Linkers can be acid cleavable, photocleavable and heat sensitive linkers. Methods for conjugation are well known by persons skilled in the art and are encompassed for use in the present invention.

According to the present invention, the GHK peptide or fragments, derivatives or variants thereof, can be linked to the first fusion partner via any suitable means, as known in the art, see for example U.S. Pat. Nos. 4,625,014, 5,057,301 and 5,514,363, which are incorporated herein in their entirety by reference. For example, the GHK peptide e can be covalently conjugated to the IgG1 Fc, either directly or through one or more linkers. In one embodiment, a GHK peptide as disclosed herein is conjugated directly to the first fusion partner (e.g. Fc), and in an alternative embodiment, a GHK peptide as disclosed herein can be conjugated to a first fusion partner (such as IgG1 Fc) via a linker, e.g. a transport enhancing linker.

A large variety of methods for conjugation of a GHK peptide as disclosed herein with a first fusion partner (e.g. Fc) are known in the art. Such methods are e.g. described by Hermanson (1996, Bioconjugate Techniques, Academic Press), in U.S. Pat. No. 6,180,084 and U.S. Pat. No. 6,264,914 which are incorporated herein in their entirety by reference and include e.g. methods used to link haptens to carriers proteins as routinely used in applied immunology (see Harlow and Lane, 1988, "Antibodies: A laboratory manual", Cold Spring Harbor Laboratory Press, Cold Spring Harbor, N.Y.). It is recognized that, in some cases, a GHK peptide can lose efficacy or functionality upon conjugation depending, e.g., on the conjugation procedure or the chemical group utilized therein. However, given the large variety of methods for conjugation the skilled person is able to find a conjugation method that does not or least affects the efficacy or functionality of the entities, such as the GHK peptide to be conjugated.

Suitable methods for conjugation of a GHK peptide as disclosed herein with a first fusion partner (e.g. Fc) include e.g. carbodimide conjugation (Bauminger and Wilchek, 1980, Meth. Enzymol. 70: 151-159). Alternatively, a moiety can be coupled to a targeting agent as described by Nagy et al., Proc. Natl. Acad. Sci. USA 93:7269-7273 (1996), and Nagy et al., Proc. Natl. Acad. Sci. USA 95:1794-1799 (1998), each of which are incorporated herein by reference. Another method for conjugating one can use is, for example sodium periodate oxidation followed by reductive alkylation of appropriate reactants and glutaraldehyde crosslinking.

One can use a variety of different linkers to conjugate a GHK peptide as disclosed herein with a first fusion partner (e.g. Fc), for example but not limited to aminocaproic horse radish peroxidase (HRP) or a heterobiofunctional cross-linker, e.g. carbonyl reactive and sulfhydryl-reactive cross-linker Heterobiofunctional cross linking reagents usually contain two reactive groups that can be coupled to two different function targets on proteins and other macromolecules in a two or three-step process, which can limit the degree of polymerization often associated with using homo-biofunctional cross-linkers. Such multi-step protocols can offer a great control of conjugate size and the molar ratio of components.

The term "linker" refers to any means to join two or more entities, for example a GHK peptide as disclosed herein with a first fusion partner (e.g. Fc). A linker can be a covalent linker or a non-covalent linker Examples of covalent linkers include covalent bonds or a linker moiety covalently attached to one or more of the proteins to be linked. The linker can also be a non-covalent bond, e.g. an organometallic bond through a metal center such as platinum atom. For covalent linkages, various functionalities can be used, such as amide groups, including carbonic acid derivatives, ethers, esters, including organic and inorganic esters, amino, urethane, urea and the like. To provide for linking, the effector molecule and/or the probe can be modified by oxidation, hydroxylation, substitution, reduction etc. to provide a site for coupling. It will be appreciated that modification which do not significantly decrease the function of the GHK peptide as disclosed herein or the first fusion partner (e.g. Fc) are preferred.

The dosage ranges for the administration of GHK peptide depend upon the form of the protein, and its potency, as described further herein, and are amounts large enough to produce the desired effect in which the symptoms, markers, or signs of emphysema and/or COPD are reduced. The dosage should not be so large as to cause adverse side effects. Generally, the dosage can vary with the age, condition, and sex of the patient and can be determined by one of skill in the art. The dosage can also be adjusted by the individual physician in the event of any complication. Typically, the dosage ranges from 0.001 mg/kg body weight to 0.5 mg/kg body weight. In one embodiment, the dose range is from 5 µg/kg body weight to 30 µg/kg body weight. The doses can be given once a day, less than once a day or multiple times a day in order to achieve a therapeutically effective dose.

With respect to the therapeutic methods of the invention, it is not intended that the administration of the GHK peptide be limited to a particular mode of administration, dosage, or frequency of dosing; the present invention contemplates all modes of administration, including intramuscular, intravenous, inhalation, intraperitoneal, intravesicular, intraarticular, intralesional, subcutaneous, or any other route sufficient to provide a dose adequate to treat the respiratory disorder, e.g., COPD and/or emphysema. The therapeutic may be administered to the patient in a single dose or in multiple doses. When multiple doses are administered, the doses may be separated from one another by, for example, one hour, three hours, six hours, eight hours, one day, two days, one week, two weeks, or one month. For example, the therapeutic may be administered for, e.g., 2, 3, 4, 5, 6, 7, 8, 10, 15, 20, or more weeks. It is to be understood that, for any particular subject, specific dosage regimes should be adjusted over time according to the individual need and the professional judgment of the person administering or supervising the administration of the compositions. For example, the dosage of the therapeutic can be increased if the lower dose does not provide sufficient therapeutic activity.

While the attending physician ultimately will decide the appropriate amount and dosage regimen, therapeutically effective amounts of the GHK peptide can be provided at a dose of 0.0001, 0.01, 0.01 0.1, 1, 5, 10, 25, 50, 100, 500, or 1,000 mg/kg. Effective doses may be extrapolated from dose-response curves derived from in vitro or animal model test bioassays or systems.

Dosages for a particular patient or subject can be determined by one of ordinary skill in the art using conventional considerations, (e.g. by means of an appropriate, conventional pharmacological protocol). A physician may, for example, prescribe a relatively low dose at first, subsequently increasing the dose until an appropriate response is obtained. The dose administered to a patient is sufficient to effect a beneficial therapeutic response in the patient over time, or, e.g., to reduce symptoms, or other appropriate activity, depending on the application. The dose is determined by the efficacy of the particular formulation, and the activity, stability or serum half-life of the GHK peptide as disclosed herein, or functional derivatives thereof, and the condition of the patient, as well as the body weight or surface area of the patient to be treated. The size of the dose is also determined by the existence, nature, and extent of any adverse side-effects that accompany the administration of a particular vector, formulation, or the like in a particular subject. Therapeutic compositions comprising a GHK peptide or functional derivatives thereof are optionally tested in one or more appropriate in vitro and/or in vivo animal models of disease, such as mice exposed to cigarette smoke (Shapiro Chest 2000 117:2235-75), to confirm efficacy, tissue metabolism, and to estimate dosages, according to methods well known in the art. In particular, dosages can be initially determined by activity, stability or other suitable measures of treatment vs. non-treatment (e.g., comparison of treated vs. untreated cells or animal models), in a relevant assay. Formulations are administered at a rate determined by the LD50 of the relevant formulation, and/or observation of any side-effects of a GHK peptide or functional derivatives thereof at various concentrations, e.g., as applied to the mass and overall health of the patient. Administration can be accomplished via single or divided doses.

In determining the effective amount of a GHK peptide or functional derivatives thereof to be administered in the treatment or prophylaxis of disease the physician evaluates circulating plasma levels, formulation toxicities, and progression of the disease.

Subjects Amenable

Certain aspects of the invention described herein relate to administering a GHK tripeptide to a patient having emphysema and/or COPD or diagnosed as having emphysema and/or COPD or at risk of having emphysema and/or COPD, and/or is in need of reversal of emphysematous damage. Certain aspects of the invention described herein relate to assessing the presence or severity of emphysema in a subject.

Subjects having emphysema and/or COPD can be identified by a physician using current methods of diagnosing emphysema and/or COPD. Symptoms of COPD and emphysema which characterize these conditions and aid in diagnosis are described above.

Subjects at risk of having or developing COPD and/or emphysema include subjects who have smoked tobacco or been exposed to tobacco smoke. Cigarette smoke is considered to be a major risk factor in the development of COPD and its effects on the lung epithelium have been well characterized. Without wishing to be constrained by theory, it is believed that cigarette smoke induces necrosis and apoptosis of both epithelial and endothelial cells which contributes to the pathogenesis of COPD.

Additional factors which increase the likelihood of a subject developing COPD and/or emphysema include, but are not limited to, asbestos, environmental factors, predisposed genetic factor (e.g. AAT deficiency), exposure to tobacco products, exposure to chemicals, pollutants, and other factors that are known to increase the risk of COPD. For example, smokers are at a higher risk in developing COPD compared to non-smokers. In one particular embodiment, a subject at risk of developing COPD and/or emphysema refers to a subject who has been smoking at least ½ to one pack of cigarettes for at least 1 year, typically at least 3 years, more typically at least 5 years, still more typically at least 10 years, and most typically at least 20 years. In certain embodiments, a subject at risk of having or developing COPD and/or emphysema is a subject who has been exposed to asbestos or a subject having a decreased level of AAT in the blood.

In some embodiments, subjects at risk of having or developing COPD and/or emphysema can be identified by measuring the levels of gene expression products of biomarkers known to be correlated with COPD and/or emphysema and comparing them to a reference level of those gene expression products. In some embodiments, subjects at risk of having or developing COPD and/or emphysema can be identified using the assays for biomarkers described elsewhere herein.

In some embodiments, a pharmaceutical composition comprising a GHK tripeptide is used to treat a respiratory disorder, e.g. emphysema. In some embodiments, the subject is selected for having a respiratory disorder before being administered a composition comprising a GHK tripeptide. In some embodiments, a composition comprising a GHK tripeptide is used to treat COPD or emphysema. In some embodiments, a subject has been screened and identified to have COPD or emphysema prior to administration of the composition comprising a GHK tripeptide. In some embodiments, the pharmaceutical composition comprising a GHK tripeptide comprises additional agents to treat COPD or other respiratory disorders.

Pharmaceutical Formulations

In some embodiments, a pharmaceutical composition comprises a GHK tripeptide, and optionally a pharmaceutically acceptable carrier. In certain embodiments, the GHK tripeptide is not complexed with copper.

The compositions encompassed by the invention may further comprise at least one pharmaceutically acceptable excipient. Excipients useful for preparing the dosages forms from the composition according to the invention and the instruments necessary to prepare them are described in U.S. Publication No.: 2003/0206954 and 2004/0052843, which are incorporated herein in their entirety by reference.

For administration to a subject, a GHK tripeptide can be provided in pharmaceutically acceptable compositions. A pharmaceutically acceptable composition can comprise a therapeutically-effective amount of a GHK tripeptide formulated together with one or more pharmaceutically acceptable carriers (additives) and/or diluents.

Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) $C_2$-$C_{12}$ alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein. In some embodiments, the carrier inhibits the degradation of the GHK tripeptide.

As described in detail below, the pharmaceutical compositions of the present invention comprising a GHK tripeptide can be specially formulated for administration to a subject in solid, liquid or gel form, including those adapted for the following: (1) oral administration, for example, drenches (aqueous or non-aqueous solutions or suspensions), lozenges, dragees, capsules, pills, tablets (e.g., those targeted for buccal, sublingual, and systemic absorption), boluses, powders, granules, pastes for application to the tongue; (2) parenteral administration, for example, by subcutaneous, intramuscular, intravenous or epidural injection as, for example, a sterile solution or suspension, or sustained-release formulation; (3) topical application, for example, as a cream, ointment, or a controlled-release patch or spray applied to the skin; (4) intravaginally or intrarectally, for example, as a pessary, cream or foam; (5) sublingually; (6) ocularly; (7) transdermally; (8) transmucosally; or (9) nasally. Additionally, a GHK tripeptide can be implanted into a patient or injected using a drug delivery system. See, for example, Urquhart, et al., Ann. Rev. Pharmacol. Toxicol. 24: 199-236 (1984); Lewis, ed. "Controlled Release of Pesticides and Pharmaceuticals" (Plenum Press, New York, 1981); U.S. Pat. No. 3,773,919; and U.S. Pat. No. 35 3,270,960. Examples of dosage forms include, but are not limited to: tablets; caplets; capsules, such as hard gelatin capsules and soft elastic gelatin capsules; cachets; troches; lozenges; dispersions; suppositories; ointments; cataplasms (poultices); pastes; powders; dressings; creams; plasters; solutions; patches; aerosols (e.g., nasal sprays or inhalers); gels; liquids such as suspensions (e.g., aqueous or non-aqueous liquid suspensions, oil-in-water emulsions, or water-in-oil liquid emulsions), solutions, and elixirs; and sterile solids (e.g., crystalline or amorphous solids) that can be reconstituted to provide liquid dosage forms.

In methods of treatment described herein, the administration of a GHK tripeptide can be for either "prophylactic" or "therapeutic" purpose. When provided prophylactically, a GHK tripeptide can be administered to a subject in advance of any symptom, e.g. a respiratory disorder, e.g. asthma attack or a diagnosis of emphysema and/or COPD. The prophylactic administration of a GHK tripeptide serves to prevent a respiratory disorder, as disclosed herein. When provided therapeutically, a GHK tripeptide is provided at (or after) the onset of a symptom or indication of respiratory disorder. Thus, a GHK tripeptide can be provided prior to the onset of respiratory disorder, e.g., onset of COPD and/or emphysema.

Toxicity and therapeutic efficacy can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compositions that exhibit large therapeutic indices are preferred.

The data obtained from the cell culture assays and animal studies can be used in formulating a range of dosage for use in humans. The dosage of such compounds lies preferably within a range of circulating concentrations that include the ED50 with little or no toxicity. The dosage may vary within this range depending upon the dosage form employed and the route of administration utilized.

The therapeutically effective dose can be estimated initially from cell culture assays. A dose may be formulated in animal models to achieve a circulating plasma concentration range that includes the IC50 (i.e., the concentration of the therapeutic which achieves a half-maximal inhibition of symptoms) as determined in cell culture. Levels in plasma may be measured, for example, by high performance liquid chromatography. The effects of any particular dosage can be monitored by a suitable bioassay. The dosage may be determined by a physician and adjusted, as necessary, to suit observed effects of the treatment.

In certain embodiments, the effective dose of a composition comprising GHK is administered to a patient once. In certain embodiments, the effective dose of a composition comprising GHK is administered to a patient repeatedly. Patients can be administered a therapeutic amount of a composition comprising GHK, such as 0.5 mg/kg, 1.0 mg/kg, 2.0 mg/kg, 2.5 mg/kg, 5 mg/kg, 10 mg/kg, 15 mg/kg, 20 mg/kg, 25 mg/kg, 30 mg/kg, 40 mg/kg or 50 mg/kg. A composition comprising GHK can be administered over a period of time, such as over a 5 minute, 10 minute, 15 minute, 20 minute, or 25 minute period. The administration is repeated, for example, on a regular basis, such as hourly for 3 hours, 6 hours, 12 hours or longer or such as biweekly (i.e., every two weeks) for one month, two months, three months, four months or longer. After an initial treatment regimen, the treatments can be administered on a less frequent basis. For example, after administration biweekly for three months, administration can be repeated once per month, for six months or a year or longer. Administration of a composition comprising GHK can reduce levels of a marker or symptom of emphysema and/or COPD, e.g., coughing or lung function impairment by at least 10%, at least 15%, at least 20%, at least 25%, at least 30%, at least 40%, at least 50%, at least 60%, at least 70%, at least 80% or at least 90% or more.

The dosage of a GHK tripeptide can be determined by a physician and adjusted, as necessary, to suit observed effects of the treatment. With respect to duration and frequency of treatment, it is typical for skilled clinicians to monitor subjects in order to determine when the treatment is providing therapeutic benefit, and to determine whether to increase or decrease dosage, increase or decrease administration frequency, discontinue treatment, resume treatment or make other alteration to treatment regimen. The dosing schedule can vary from once a week to daily depending on a number of clinical factors, such as the subject's sensitivity to the polypeptides. The desired dose can be administered at one time or divided into subdoses, e.g., 2-4 subdoses and administered over a period of time, e.g., at appropriate intervals through the day or other appropriate schedule. Such subdoses can be administered as unit dosage forms. In some embodiments, administration is chronic, e.g., one or more doses daily over a period of weeks or months. Examples of dosing schedules are administration daily, twice daily, three times daily or four or more times daily over a period of 1 week, 2 weeks, 3 weeks, 4 weeks, 1 month, 2 months, 3 months, 4 months, 5 months, or 6 months or more.

Combination Therapies

As disclosed herein, a GHK tripeptide can be administrated to a subject alone, or optionally in combination (e.g. simultaneously with, sequentially or separately) with one or more pharmaceutically active agents, e.g. a second therapeutic agent known to be beneficial in treating emphysema and/or COPD. For example, exemplary pharmaceutically active compound include, but are not limited to, those found in *Harrison's principals of Internal Medicine*, 13$^{th}$ Edition, Eds. T. R. Harrison et al. McGraw-Hill N.Y., NY; Physicians Desk Reference, 50$^{th}$ Edition, 1997, Oradell New Jersey, Medical Economics Co.; Pharmacological Basis of Therapeutics, 8$^{th}$ Edition, Goodman and Gilman, 1990; United States Pharmacopeia, The National Formulary, USP XII NF XVII, 1990; current edition of Goodman and Oilman's *The Pharmacological Basis of Therapeutics*; and current edition of *The Merck Index*, the complete contents of all of which are incorporated herein by reference. By way of non-limiting example, such therapeutic agents include bronchodialators (e.g. short and long acting β-2 stimulants), orally administered bronchodilators, anti-cholinergic agents (e.g. ipratoprium bromide, theophylline compounds or a combination), inhaled anti-cholinergic agents, steroids (oral or topical), especially corticosteroids, mucolytic agents (e.g., ambroxol, ergosterin, carbocysteine, iodinated glycerol), antibiotics, antifungals, moisterization by nebulization, anti-tussives, respiratory stimulants (e.g., doxapram, almitrine bismesylate), α-1 antitrypsin administration, fromoterol, budesonide, and/or fromoterol/budesonide combination therapy.

In certain embodiments, the composition comprising a GHK tripeptide can further comprise, for example, an asthma agent. Exemplary agents known to treat asthma include, but are not limited to, mast cell degranulation agents (i.e., Cromylyn sodium or Nedocromil sodium), leukotriene inhibitors (i.e., Monteleukast sodium, Zafirlukast, or Pranlukast hydrate), corticosteroids (i.e., Beclomethasone, Budesonide, Ciclesonide, Hydrolysable glucocorticoid, Triamcinolone acetonide, Flunisolide, Mometasone furcate, or Fluticasone propionate), IgE binding inhibitors (i.e., Omalizumab), Adenosine A2 agonists, Anti-CD23 antibody, E-Selectin antagonists, P-Selectin antagonists, L-Selectin antagonists, interleukin inhibitors/monoclonal antibodies, pulmonary surfactants, neurokinin antagonists, NF-Kappa-B inhibitors, PDE-4 inhibitors (i.e., Cilomilast, or Roflumilast), Thromboxan A2 inhibitors (i.e., Rama-gotroban, or Seratrodast), tryptase inhibitors, VIP agonists or antisense agents.

In some embodiments, a composition comprising a GHK tripeptide and a pharmaceutically active agent can be administrated to the subject in the same pharmaceutical composition or in different pharmaceutical compositions (at the same time or at different times). When administrated at different times, a composition comprising a GHK tripeptide and the additional pharmaceutically active agent can be administered within 5 minutes, 10 minutes, 20 minutes, 60 minutes, 2 hours, 3 hours, 4, hours, 8 hours, 12 hours, 24 hours of administration of the other. When a composition comprising a GHK tripeptide and the pharmaceutically active agent are administered in different pharmaceutical compositions, routes of administration can be different. For example, a composition comprising a GHK tripeptide can be administered by any appropriate route known in the art including, but not limited to oral or parenteral routes, including intravenous, intramuscular, subcutaneous, transdermal, airway (aerosol), pulmonary, nasal, rectal, and topical (including buccal and sublingual) administration, and the pharmaceutically active agent is administered by a different route, e.g. a route commonly used in the art for administration of the pharmaceutically active agent.

In some embodiments, a composition comprising a GHK tripeptide can precede, can be co-current with and/or follow the pharmaceutically active agent by intervals ranging from minutes to weeks. In embodiments where a composition comprising a GHK tripeptide and a pharmaceutically active agent are applied separately to a cell, tissue or organism, one would generally ensure that a significant period of time did not expire between the time of each delivery, such that the composition comprising a GHK tripeptide and a pharmaceutically active agent would still be able to exert an advantageously combined effect on the cell, tissue or organism.

In some embodiments, the invention contemplates the use of a composition comprising a GHK tripeptide and the practice of the methods described herein in conjunction with other therapies such as surgery, e.g., enlarging a sinus passage, remove obstructing bone or nasal polyps, mucosal stripping, removal of sinuses, bullectomy, lung volume reduction surgery, or lung transplantation.

Aerosol Formulations

A composition comprising a GHK tripeptide can be administered directly to the airways of a subject in the form of an aerosol or by nebulization. For use as aerosols, a GHK tripeptide in solution or suspension may be packaged in a pressurized aerosol container together with suitable propellants, for example, hydrocarbon propellants like propane, butane, or isobutane with conventional adjuvants. A GHK tripeptide can also be administered in a non-pressurized form such as in a nebulizer or atomizer.

The term "nebulization" is well known in the art to include reducing liquid to a fine spray. Preferably, by such nebulization small liquid droplets of uniform size are produced from a larger body of liquid in a controlled manner. Nebulization can be achieved by any suitable means therefore, including by using many nebulizers known and marketed today. For example, an AEROMIST pneumatic nebulizer available from Inhalation Plastic, Inc. of Niles, Ill. When the active ingredients are adapted to be administered, either together or individually, via nebulizer(s) they can be in the form of a nebulized aqueous suspension or solution, with or without a suitable pH or tonicity adjustment, either as a unit dose or multidose device.

As is well known, any suitable gas can be used to apply pressure during the nebulization, with preferred gases to date being those which are chemically inert to a modulator of a GHK tripeptide. Exemplary gases including, but are not limited to, nitrogen, argon or helium can be used to high advantage.

In some embodiments, a GHK tripeptide can also be administered directly to the airways in the form of a dry powder. For use as a dry powder, a GHK tripeptide can be administered by use of an inhaler. Exemplary inhalers include metered dose inhalers and dry powdered inhalers.

A metered dose inhaler or "MDI" is a pressure resistant canister or container filled with a product such as a pharmaceutical composition dissolved in a liquefied propellant or micronized particles suspended in a liquefied propellant. The propellants which can be used include chlorofluorocarbons, hydrocarbons or hydrofluoroalkanes. Especially preferred propellants are P134a (tetrafluoroethane) and P227 (heptafluoropropane) each of which may be used alone or in combination. They are optionally used in combination with one or more other propellants and/or one or more surfactants and/or one or more other excipients, for example ethanol, a lubricant, an anti-oxidant and/or a stabilizing agent. The correct dosage of the composition is delivered to the patient.

A dry powder inhaler (i.e. Turbuhaler (Astra AB)) is a system operable with a source of pressurized air to produce dry powder particles of a pharmaceutical composition that is compacted into a very small volume.

Dry powder aerosols for inhalation therapy are generally produced with mean diameters primarily in the range of <5 μm. As the diameter of particles exceeds 3 μm, there is increasingly less phagocytosis by macrophages. However, increasing the particle size also has been found to minimize the probability of particles (possessing standard mass density) entering the airways and acini due to excessive deposition in the oropharyngeal or nasal regions.

Suitable powder compositions include, by way of illustration, powdered preparations of a GHK tripeptide thoroughly intermixed with lactose, or other inert powders acceptable for intrabronchial administration. The powder compositions can be administered via an aerosol dispenser or encased in a breakable capsule which may be inserted by the patient into a device that punctures the capsule and blows the powder out in a steady stream suitable for inhalation. The compositions can include propellants, surfactants, and co-solvents and may be filled into conventional aerosol containers that are closed by a suitable metering valve.

Aerosols for the delivery to the respiratory tract are known in the art. See for example, Adjei, A. and Garren, J. Pharm. Res., 1: 565-569 (1990); Zanen, P. and Lamm, J.-W. J. Int. J. Pharm., 114: 111-115 (1995); Gonda, I. "Aerosols for delivery of therapeutic an diagnostic agents to the respiratory tract," in *Critical Reviews in Therapeutic Drug Carrier Systems*, 6:273-313 (1990); Anderson et al., *Am. Rev. Respir. Dis.*, 140: 1317-1324 (1989)) and have potential for the systemic delivery of peptides and proteins as well (Patton and Platz, *Advanced Drug Delivery Reviews*, 8:179-196 (1992)); Timsina et. al., *Int. J. Pharm.*, 101: 1-13 (1995); and Tansey, I. P., *Spray Technol. Market*, 4:26-29 (1994); French, D. L., Edwards, D. A. and Niven, R. W., *Aerosol Sci.*, 27: 769-783 (1996); Visser, J., *Powder Technology* 58: 1-10 (1989)); Rudt, S, and R. H. Muller, J. *Controlled Release*, 22: 263-272 (1992); Tabata, Y, and Y. Ikada, *Biomed. Mater. Res.*, 22: 837-858 (1988); Wall, D. A., *Drug Delivery*, 2: 10 1-20 1995); Patton, J. and Platz, R., *Adv. Drug Del. Rev.*, 8: 179-196 (1992); Bryon, P., *Adv. Drug. Del. Rev.*, 5: 107-132 (1990); Patton, J. S., et al., *Controlled Release*, 28: 15 79-85 (1994); Damms, B. and Bains, W., *Nature Biotechnology* (1996); Niven, R. W., et al., *Pharm. Res.*, 12(9); 1343-1349 (1995); and Kobayashi, S., et al., *Pharm. Res.*, 13(1): 80-83 (1996), contents of all of which are herein incorporated by reference in their entirety.

Oral Dosage Formulations

Pharmaceutical compositions comprising a GHK tripeptide can also be formulated to be suitable for oral administration, for example as discrete dosage forms, such as, but not limited to, tablets (including without limitation scored or coated tablets), pills, caplets, capsules, chewable tablets, powder packets, cachets, troches, wafers, aerosol sprays, or liquids, such as but not limited to, syrups, elixirs, solutions or suspensions in an aqueous liquid, a non-aqueous liquid, an oil-in-water emulsion, or a water-in-oil emulsion. Such compositions contain a predetermined amount of the pharmaceutically acceptable salt of the disclosed compounds, and may be prepared by methods of pharmacy well known to those skilled in the art. See generally, *Remington's Pharmaceutical Sciences,* 18th ed., Mack Publishing, Easton, Pa. (1990).

Typical oral dosage forms of the compositions of the disclosure are prepared by combining the pharmaceutically acceptable salt of disclosed compounds in an intimate admixture with at least one excipient according to conventional pharmaceutical compounding techniques. Excipients can take a wide variety of forms depending on the form of the composition desired for administration. For example, excipients suitable for use in oral liquid or aerosol dosage forms include, but are not limited to, water, glycols, oils, alcohols, flavoring agents, preservatives, and coloring agents. Examples of excipients suitable for use in solid oral dosage forms (e.g., powders, tablets, capsules, and caplets) include, but are not limited to, starches, sugars, microcrystalline cellulose, kaolin, diluents, granulating agents, lubricants, binders, and disintegrating agents. Due to their ease of administration, tablets and capsules represent the most advantageous solid oral dosage unit forms, in which case solid pharmaceutical excipients are used. If desired, tablets can be coated by standard aqueous or nonaqueous techniques. These dosage forms can be prepared by any of the methods of pharmacy. In general, pharmaceutical compositions and dosage forms are prepared by uniformly and intimately admixing the active ingredient(s) with liquid carriers, finely divided solid carriers, or both, and then shaping the product into the desired presentation if necessary.

For example, a tablet can be prepared by compression or molding. Compressed tablets can be prepared by compressing in a suitable machine the active ingredient(s) in a free-flowing form, such as a powder or granules, optionally mixed with one or more excipients. Molded tablets can be made by molding in a suitable machine a mixture of the powdered compound moistened with an inert liquid diluent. Examples of excipients that can be used in oral dosage forms of the disclosure include, but are not limited to, binders, fillers, disintegrants, and lubricants. Binders suitable for use in pharmaceutical compositions and dosage forms include, but are not limited to, corn starch, potato starch, or other starches, gelatin, natural and synthetic gums such as acacia, sodium alginate, alginic acid, other alginates, powdered tragacanth, guar gum, cellulose and its derivatives (e.g., ethyl cellulose, cellulose acetate, carboxymethyl cellulose calcium, sodium carboxymethyl cellulose), polyvinyl pyrrolidone, methyl cellulose, pre-gelatinized starch, hydroxypropyl methyl cellulose, (e.g., Nos. 2208, 2906, 2910), microcrystalline cellulose, and mixtures thereof.

Suitable forms of microcrystalline cellulose include, but are not limited to, the materials sold as AVICEL-PH-101, AVICEL-PH-103 AVICEL RC-581, and AVICEL-PH-105 (available from FMC Corporation, American Viscose Division, Avicel Sales, Marcus Hook, Pa., U.S.A.), and mixtures thereof. An exemplary suitable binder is a mixture of microcrystalline cellulose and sodium carboxymethyl cellulose sold as AVICEL RC-581. Suitable anhydrous or low moisture excipients or additives include AVICEL-PH-103™ and Starch 1500 LM.

Examples of fillers suitable for use in the pharmaceutical compositions and dosage forms disclosed herein include, but are not limited to, talc, calcium carbonate (e.g., granules or powder), microcrystalline cellulose, powdered cellulose, dextrates, kaolin, mannitol, silicic acid, sorbitol, starch, pre-gelatinized starch, and mixtures thereof. The binder or filler in pharmaceutical compositions of the disclosure is typically present in from about 50 to about 99 weight percent of the pharmaceutical composition or dosage form.

Disintegrants are used in the compositions of the disclosure to provide tablets that disintegrate when exposed to an aqueous environment. Tablets that contain too much disintegrant may swell, crack, or disintegrate in storage, while those that contain too little may be insufficient for disintegration to occur and may thus alter the rate and extent of release of the active ingredient(s) from the dosage form. Thus, a sufficient amount of disintegrant that is neither too little nor too much to detrimentally alter the release of the active ingredient(s) should be used to form solid oral dosage forms of the disclosure. The amount of disintegrant used varies based upon the type of formulation and mode of administration, and is readily discernible to those of ordinary skill in the art. Typical pharmaceutical compositions comprise from about 0.5 to about 15 weight percent of disintegrant, preferably from about 1 to about 5 weight percent of disintegrant.

Disintegrants that can be used to form pharmaceutical compositions and dosage forms of the disclosure include, but are not limited to, agar, alginic acid, calcium carbonate, microcrystalline cellulose, croscarmellose sodium, crospovidone, polacrilin potassium, sodium starch glycolate, potato or tapioca starch, other starches, pre-gelatinized starch, clays, other algins, other celluloses, gums, and mixtures thereof.

Lubricants that can be used to form pharmaceutical compositions and dosage forms of the disclosure include, but are not limited to, calcium stearate, magnesium stearate, mineral oil, light mineral oil, glycerin, sorbitol, mannitol, polyethylene glycol, other glycols, stearic acid, sodium lauryl sulfate, talc, hydrogenated vegetable oil (e.g., peanut oil, cottonseed oil, sunflower oil, sesame oil, olive oil, corn oil, and soybean oil), zinc stearate, ethyl oleate, ethyl laureate, agar, and mixtures thereof. Additional lubricants include, for example, a syloid silica gel (AEROSIL® 200, manufactured by W. R. Grace Co. of Baltimore, Md.), a coagulated aerosol of synthetic silica (marketed by Degussa Co. of Piano, Tex.), CAB-O-SIL® (a pyrogenic silicon dioxide product sold by Cabot Co. of Boston, Mass.), and mixtures thereof. If used at all, lubricants are typically used in an amount of less than about 1 weight percent of the pharmaceutical compositions or dosage forms into which they are incorporated.

This disclosure further encompasses lactose-free pharmaceutical compositions and dosage forms, wherein such compositions preferably contain little, if any, lactose or other mono- or di-saccharides. As used herein, the term "lactose-free" means that the amount of lactose present, if any, is insufficient to substantially increase the degradation rate of an active ingredient.

Lactose-free compositions of the disclosure can comprise excipients which are well known in the art and are listed in the USP (XXI)/NF (XVI), which is incorporated herein by reference. In general, lactose-free compositions comprise a pharmaceutically acceptable salt of an HIF inhibitor, a binder/filler, and a lubricant in pharmaceutically compatible and pharmaceutically acceptable amounts. Preferred lactose-free dosage forms comprise a pharmaceutically acceptable salt of the disclosed compounds, microcrystalline cellulose, pre-gelatinized starch, and magnesium stearate.

This disclosure further encompasses anhydrous pharmaceutical compositions and dosage forms comprising the disclosed compounds as active ingredients, since water can facilitate the degradation of some compounds. For example, the addition of water (e.g., 5%) is widely accepted in the pharmaceutical arts as a means of simulating long-term storage in order to determine characteristics such as shelf life or the stability of formulations over time. See, e.g., Jens T. Carstensen, Drug Stability: Principles & Practice, 379-80 (2nd ed., Marcel Dekker, NY, N.Y.: 1995). Water and heat accelerate the decomposition of some compounds. Thus, the effect of water on a formulation can be of great significance since moisture and/or humidity are commonly encountered during manufacture, handling, packaging, storage, shipment, and use of formulations.

Anhydrous pharmaceutical compositions and dosage forms of the disclosure can be prepared using anhydrous or low moisture containing ingredients and low moisture or low humidity conditions. Pharmaceutical compositions and dosage forms that comprise lactose and at least one active ingredient that comprises a primary or secondary amine are preferably anhydrous if substantial contact with moisture and/or humidity during manufacturing, packaging, and/or storage is expected.

An anhydrous pharmaceutical composition should be prepared and stored such that its anhydrous nature is maintained. Accordingly, anhydrous compositions are preferably packaged using materials known to prevent exposure to water such that they can be included in suitable formulary kits. Examples of suitable packaging include, but are not limited to, hermetically sealed foils, plastics, unit dose containers (e.g., vials) with or without desiccants, blister packs, and strip packs.

For oral administration, the dosage should contain at least at least 0.1% of a GHK tripeptide. The percentage of a GHK tripeptide in these compositions may, of course, be varied and may conveniently be between about 2% to about 60% of the weight of the unit. The amount of a GHK tripeptide in such therapeutically useful compositions is such that a suitable dosage will be obtained.

Controlled Release Forms

In some embodiments, a GHK tripeptide can be administered by controlled- or delayed-release means. Controlled-release pharmaceutical products have a common goal of improving drug therapy over that achieved by their non-controlled release counterparts. Ideally, the use of an optimally designed controlled-release preparation in medical treatment is characterized by a minimum of drug substance being employed to cure or control the condition in a minimum amount of time. Advantages of controlled-release formulations include: 1) extended activity of the drug; 2) reduced dosage frequency; 3) increased patient compliance; 4) usage of less total drug; 5) reduction in local or systemic side effects; 6) minimization of drug accumulation; 7) reduction in blood level fluctuations; 8) improvement in efficacy of treatment; 9) reduction of potentiation or loss of drug activity; and 10) improvement in speed of control of diseases or conditions. Kim, Chemg-ju, Controlled Release Dosage Form Design, 2 (Technomic Publishing, Lancaster, Pa.: 2000).

Conventional dosage forms generally provide rapid or immediate drug release from the formulation. Depending on the pharmacology and pharmacokinetics of the drug, use of conventional dosage forms can lead to wide fluctuations in the concentrations of the drug in a patient's blood and other tissues. These fluctuations can impact a number of parameters, such as dose frequency, onset of action, duration of efficacy, maintenance of therapeutic blood levels, toxicity, side effects, and the like. Advantageously, controlled-release formulations can be used to control a drug's onset of action, duration of action, plasma levels within the therapeutic window, and peak blood levels. In particular, controlled- or extended-release dosage forms or formulations can be used to ensure that the maximum effectiveness of a drug is achieved while minimizing potential adverse effects and safety concerns, which can occur both from under-dosing a drug (i.e., going below the minimum therapeutic levels) as well as exceeding the toxicity level for the drug.

Most controlled-release formulations are designed to initially release an amount of drug (active ingredient) that promptly produces the desired therapeutic effect, and gradually and continually release other amounts of drug to maintain this level of therapeutic or prophylactic effect over an extended period of time. In order to maintain this constant level of drug in the body, the drug must be released from the dosage form at a rate that will replace the amount of drug being metabolized and excreted from the body. Controlled-release of an active ingredient can be stimulated by various conditions including, but not limited to, pH, ionic strength, osmotic pressure, temperature, enzymes, water, and other physiological conditions or compounds.

A variety of known controlled- or extended-release dosage forms, formulations, and devices can be adapted for use with the salts and compositions of the disclosure. Examples include, but are not limited to, those described in U.S. Pat. Nos. 3,845,770; 3,916,899; 3,536,809; 3,598,123; 4,008,719; 5674,533; 5,059,595; 5,591,767; 5,120,548; 5,073,543; 5,639,476; 5,354,556; 5,733,566; and 6,365,185 B1; each of which is incorporated herein by reference. These dosage forms can be used to provide slow or controlled-release of one or more active ingredients using, for example, hydroxypropylmethyl cellulose, other polymer matrices, gels, permeable membranes, osmotic systems (such as OROS® (Alza Corporation, Mountain View, Calif. USA)), multilayer coatings, microparticles, liposomes, or microspheres or a combination thereof to provide the desired release profile in varying proportions. Additionally, ion exchange materials can be used to prepare immobilized, adsorbed salt forms of the disclosed compounds and thus effect controlled delivery of the drug. Examples of specific anion exchangers include, but are not limited to, Duolite® A568 and Duolite® AP143 (Rohm&Haas, Spring House, Pa. USA).

One embodiment of the disclosure encompasses a unit dosage form that includes a pharmaceutically acceptable salt of the disclosed compounds (e.g., a sodium, potassium, or lithium salt), or a polymorph, solvate, hydrate, dehydrate, co-crystal, anhydrous, or amorphous form thereof, and one or more pharmaceutically acceptable excipients or diluents, wherein the pharmaceutical composition or dosage form is formulated for controlled-release. Specific dosage forms utilize an osmotic drug delivery system.

A particular and well-known osmotic drug delivery system is referred to as OROS® (Alza Corporation, Mountain View, Calif. USA). This technology can readily be adapted for the delivery of compounds and compositions of the disclosure. Various aspects of the technology are disclosed in U.S. Pat. Nos. 6,375,978 B1; 6,368,626 B1; 6,342,249 B1; 6,333,050 B2; 6,287,295 B1; 6,283,953 B1; 6,270,787 B1; 6,245,357 B1; and 6,132,420; each of which is incorporated herein by reference. Specific adaptations of OROS® that can be used to administer compounds and compositions of the disclosure include, but are not limited to, the OROS®

Push-Pull™, Delayed Push-Pull™, Multi-Layer Push-Pull™, and Push-Stick™ Systems, all of which are well known. See, e.g. worldwide website alza.com. Additional OROS® systems that can be used for the controlled oral delivery of compounds and compositions of the disclosure include OROS®-CT and L-OROS®; see, Delivery Times, vol. 11, issue II (Alza Corporation).

Conventional OROS® oral dosage forms are made by compressing a drug powder (e.g., a GHK tripeptide which is a salt) into a hard tablet, coating the tablet with cellulose derivatives to form a semi-permeable membrane, and then drilling an orifice in the coating (e.g., with a laser). Kim, Chemg-ju, Controlled Release Dosage Form Design, 231-238 (Technomic Publishing, Lancaster, Pa.: 2000). The advantage of such dosage forms is that the delivery rate of the drug is not influenced by physiological or experimental conditions. Even a drug with a pH-dependent solubility can be delivered at a constant rate regardless of the pH of the delivery medium. But because these advantages are provided by a build-up of osmotic pressure within the dosage form after administration, conventional OROS® drug delivery systems cannot be used to effectively delivery drugs with low water solubility.

In some embodiments, a specific dosage form of the GHK tripeptide compositions of the disclosure includes: a wall defining a cavity, the wall having an exit orifice formed or formable therein and at least a portion of the wall being semipermeable; an expandable layer located within the cavity remote from the exit orifice and in fluid communication with the semipermeable portion of the wall; a dry or substantially dry state drug layer located within the cavity adjacent the exit orifice and in direct or indirect contacting relationship with the expandable layer; and a flow-promoting layer interposed between the inner surface of the wall and at least the external surface of the drug layer located within the cavity, wherein the drug layer includes a GHK tripeptide, or a polymorph, solvate, hydrate, dehydrate, co-crystal, anhydrous, or amorphous form thereof. See U.S. Pat. No. 6,368,626, the entirety of which is incorporated herein by reference.

In another embodiment, a specific dosage form of the GHK tripeptide includes: a wall defining a cavity, the wall having an exit orifice formed or formable therein and at least a portion of the wall being semipermeable; an expandable layer located within the cavity remote from the exit orifice and in fluid communication with the semipermeable portion of the wall; a drug layer located within the cavity adjacent the exit orifice and in direct or indirect contacting relationship with the expandable layer; the drug layer comprising a liquid, active agent formulation absorbed in porous particles, the porous particles being adapted to resist compaction forces sufficient to form a compacted drug layer without significant exudation of the liquid, active agent formulation, the dosage form optionally having a placebo layer between the exit orifice and the drug layer, wherein the active agent formulation comprises a GHK tripeptide, or a polymorph, solvate, hydrate, dehydrate, co-crystal, anhydrous, or amorphous form thereof. See U.S. Pat. No. 6,342,249, the entirety of which is incorporated herein by reference.

In some embodiments, a GHK tripeptide is administered to a subject by sustained release or in pulses. Pulse therapy is not a form of discontinuous administration of the same amount of a composition over time, but comprises administration of the same dose of the composition at a reduced frequency or administration of reduced doses. Sustained release or pulse administration is particularly preferred when the respiratory disorder occurs continuously in the subject, for example where the subject has continuous symptoms of a respiratory disorder. Each pulse dose can be reduced and the total amount of drug administered over the course of treatment to the patient is minimized.

In some embodiments, individual pulses can be delivered to the patient continuously over a period of several hours, such as about 2, 4, 6, 8, 10, 12, 14 or 16 hours, or several days, such as 2, 3, 4, 5, 6, or 7 days, preferably from about 1 hour to about 24 hours and more preferably from about 3 hours to about 9 hours.

In some embodiments, an interval between pulses or an interval of no delivery is greater than 24 hours and preferably greater than 48 hours, and can be for even longer such as for 3, 4, 5, 6, 7, 8, 9 or 10 days, two, three or four weeks or even longer. As the results achieved may be surprising, the interval between pulses, when necessary, can be determined by one of ordinary skill in the art. Often, the interval between pulses can be calculated by administering another dose of the composition when the composition or the active component of the composition is no longer detectable in the patient prior to delivery of the next pulse. Intervals can also be calculated from the in vivo half-life of the composition. Intervals may be calculated as greater than the in vivo half-life, or 2, 3, 4, 5 and even 10 times greater the composition half-life.

In some embodiments, the number of pulses in a single therapeutic regimen may be as little as two, but is typically from about 5 to 10, 10 to 20, 15 to 30 or more. In fact, patients can receive drugs for life according to the methods of this invention without the problems and inconveniences associated with current therapies. Compositions can be administered by most any means, but are preferable delivered to the patient as an injection (e.g. intravenous, subcutaneous, and intraarterial), infusion or instillation. Various methods and apparatus for pulsing compositions by infusion or other forms of delivery to the patient are disclosed in U.S. Pat. Nos. 4,747,825; 4,723,958; 4,948,592; 4,965,251 and 5,403,590. Sustained release can also be accomplished by means of an osmotic pump. In some embodiments, a GHK tripeptide is administered over a period of several days, such as 2, 3, 4, 5, 6 or 7 days.

Parenteral Dosage Forms

In some embodiments, parenteral dosage forms of a modulator of a GHK tripeptide can also be administered to a subject with a respiratory disorder by various routes, including, but not limited to, subcutaneous, intravenous (including bolus injection), intramuscular, and intraarterial. Since administration of parenteral dosage forms typically bypasses the patient's natural defenses against contaminants, parenteral dosage forms are preferably sterile or capable of being sterilized prior to administration to a patient. Examples of parenteral dosage forms include, but are not limited to, solutions ready for injection, dry products ready to be dissolved or suspended in a pharmaceutically acceptable vehicle for injection, suspensions ready for injection, and emulsions. In addition, controlled-release parenteral dosage forms can be prepared for administration of a patient, including, but not limited to, administration DUROS®-type dosage forms, and dose-dumping.

Suitable vehicles that can be used to provide parenteral dosage forms of the GHK as disclosed within are well known to those skilled in the art. Examples include, without limitation: sterile water; water for injection USP; saline solution; glucose solution; aqueous vehicles such as but not limited to, sodium chloride injection, Ringer's injection, dextrose Injection, dextrose and sodium chloride injection, and lactated Ringer's injection; water-miscible vehicles such as, but not limited to, ethyl alcohol, polyethylene glycol, and propylene glycol; and non-aqueous vehicles such as, but not limited to, corn oil, cottonseed oil, peanut oil, sesame oil, ethyl oleate, isopropyl myristate, and benzyl benzoate.

Compounds that alter or modify the solubility of a pharmaceutically acceptable salt of a GHK tripeptide as disclosed herein can also be incorporated into the parenteral dosage forms of the disclosure, including conventional and controlled-release parenteral dosage forms.

Topical, Transdermal and Mucosal Dosage Forms

In some embodiments, the GHK peptide can be administered to a subject topically. In some embodiments, topical dosage forms of the GHK peptide include, but are not limited to, creams, lotions, ointments, gels, shampoos, sprays, aerosols, solutions, emulsions, and other forms known to one of skill in the art. See, e.g., Remington's Pharmaceutical Sciences, 18th ed., Mack Publishing, Easton, Pa. (1990); and Introduction to Pharmaceutical Dosage Forms, 4th ed., Lea & Febiger, Philadelphia, Pa. (1985). For non-sprayable topical dosage forms, viscous to semi-solid or solid forms comprising a carrier or one or more excipients compatible with topical application and having a dynamic viscosity preferably greater than water are typically employed. Suitable formulations include, without limitation, solutions, suspensions, emulsions, creams, ointments, powders, liniments, salves, and the like, which are, if desired, sterilized or mixed with auxiliary agents (e.g., preservatives, stabilizers, wetting agents, buffers, or salts) for influencing various properties, such as, for example, osmotic pressure. Other suitable topical dosage forms include sprayable aerosol preparations wherein the active ingredient, preferably in combination with a solid or liquid inert carrier, is packaged in a mixture with a pressurized volatile (e.g., a gaseous propellant, such as freon), or in a squeeze bottle. Moisturizers or humectants can also be added to pharmaceutical compositions and dosage forms if desired. Examples of such additional ingredients are well known in the art. See, e.g., Remington's Pharmaceutical Sciences, 18.sup.th Ed., Mack Publishing, Easton, Pa. (1990).

Transdermal and mucosal dosage forms of the compositions comprising a modulator of a GHK tripeptide as disclosed herein include, but are not limited to, ophthalmic solutions, patches, sprays, aerosols, creams, lotions, suppositories, ointments, gels, solutions, emulsions, suspensions, or other forms known to one of skill in the art. See, e.g., Remington's Pharmaceutical Sciences, 18th Ed., Mack Publishing, Easton, Pa. (1990); and Introduction to Pharmaceutical Dosage Forms, 4th Ed., Lea & Febiger, Philadelphia, Pa. (1985). Dosage forms suitable for treating mucosal tissues within the oral cavity can be formulated as mouthwashes, as oral gels, or as buccal patches. Additional transdermal dosage forms include "reservoir type" or "matrix type" patches, which can be applied to the skin and worn for a specific period of time to permit the penetration of a desired amount of active ingredient.

Examples of transdermal dosage forms and methods of administration that can be used to administer the active ingredient(s) of the disclosure include, but are not limited to, those disclosed in U.S. Pat. Nos. 4,624,665; 4,655,767; 4,687,481; 4,797,284; 4,810,499; 4,834,978; 4,877,618; 4,880,633; 4,917,895; 4,927,687; 4,956,171; 5,035,894; 5,091,186; 5,163,899; 5,232,702; 5,234,690; 5,273,755; 5,273,756; 5,308,625; 5,356,632; 5,358,715; 5,372,579; 5,421,816; 5,466,465; 5,494,680; 5,505,958; 5,554,381; 5,560,922; 5,585,111; 5,656,285; 5,667,798; 5,698,217; 5,741,511; 5,747,783; 5,770,219; 5,814,599; 5,817,332; 5,833,647; 5,879,322; and 5,906,830, each of which are incorporated herein by reference in their entirety.

Suitable excipients (e.g., carriers and diluents) and other materials that can be used to provide transdermal and mucosal dosage forms encompassed by this disclosure are well known to those skilled in the pharmaceutical arts, and depend on the particular tissue or organ to which a given pharmaceutical composition or dosage form will be applied. With that fact in mind, typical excipients include, but are not limited to water, acetone, ethanol, ethylene glycol, propylene glycol, butane-1,3-diol, isopropyl myristate, isopropyl palmitate, mineral oil, and mixtures thereof, to form dosage forms that are non-toxic and pharmaceutically acceptable.

Depending on the specific tissue to be treated, additional components may be used prior to, in conjunction with, or subsequent to treatment with a GHK tripeptide. For example, penetration enhancers can be used to assist in delivering the active ingredients to or across the tissue. Suitable penetration enhancers include, but are not limited to: acetone; various alcohols such as ethanol, oleyl, an tetrahydrofuryl; alkyl sulfoxides such as dimethyl sulfoxide; dimethyl acetamide; dimethyl formamide; polyethylene glycol; pyrrolidones such as polyvinylpyrrolidone; Kollidon grades (Povidone, Polyvidone); urea; and various water-soluble or insoluble sugar esters such as TWEEN 80 (polysorbate 80) and SPAN 60 (sorbitan monostearate).

The pH of a pharmaceutical composition or dosage form, or of the tissue to which the pharmaceutical composition or dosage form is applied, may also be adjusted to improve delivery of the active ingredient(s). Similarly, the polarity of a solvent carrier, its ionic strength, or tonicity can be adjusted to improve delivery. Compounds such as stearates can also be added to pharmaceutical compositions or dosage forms to advantageously alter the hydrophilicity or lipophilicity of the active ingredient(s) so as to improve delivery. In this regard, stearates can serve as a lipid vehicle for the formulation, as an emulsifying agent or surfactant, and as a delivery-enhancing or penetration-enhancing agent. Different hydrates, dehydrates, co-crystals, solvates, polymorphs, anhydrous, or amorphous forms of the pharmaceutically acceptable salt of a GHK tripeptide can be used to further adjust the properties of the resulting composition.

Assessing Emphysema in a Subject

As described herein, the inventors have identified certain genes which are upregulated or downregulated to a statistically significant degree in tissue which is subject to emphysematous tissue damage as compared to a reference sample. Herein, we are sometimes referring to these genes as marker genes to indicate their relation to being a marker for emphysema. Accordingly, some embodiments of the invention are generally related to assays, methods and systems for assessing the emphysematous state of the lung(s) of a subject. In certain embodiments, the assays, methods and systems relate to identifying a subject with emphysema or a need for treatment for emphysema. Certain embodiments of the invention are related to assays, methods and systems for identifying the severity of emphysema in a sample taken from the lung of a subject. In certain embodiments, the assays, methods and systems are directed to determination of the expression level of a gene product (e.g. protein and/or gene transcript such as mRNA) in a biological sample of a subject. In certain embodiments the assays, methods, and systems are directed to determination of the expression level of a gene product of at least two genes in a biological sample of a subject, i.e. at least two genes, at least three genes, at least four genes, at least five genes, at least six genes, at least seven genes, at least eight genes, at least nine genes, at least 10 genes . . . at least 15 genes, . . . at least 25 genes, . . . at least 30 genes, or more genes, or any number of genes selected from any in a combination of Table 1 and Table 2 as described herein. Preferably, one looks at a group of genes where some increase in expression and others decrease in expression. In some embodiments, the expression level of a gene product of the same number of genes from each of Tables 1 and 2 is determined, e.g. two genes from each table. In some embodiments, the expression level of a gene product of different numbers of genes from each of Tables 1 and 2 is determined, e.g. two genes from Table 1 and 4 genes from Table 2 or 6 genes from Table 1 and 3 genes from Table 2. In some embodiments, the marker genes are selected from at least the group consisting of ITGB1, NEDD9, ACVRL1, SMAD6 and TGFBR2. In some embodiments, the assays, methods, and systems described herein are directed to determination of the expression level of a gene product of at least two genes in a biological sample of a subject, e.g. at least two genes, or at least three genes, or at least four genes, or all of the following genes; ITGB1, NEDD9, ACVRL1, SMAD6 and TGFBR2.

The term "Lm" which is used in Table 1, Table 2, and elsewhere herein refers to a continuous measure of the severity of emphysematous lung damage and is a measure of the size of the alveole as measured by the distance between alveolar walls. Mean linear intercept (Lm) was measured at 20 regularly spaced intervals of each of the microCT scans of lung samples adjacent to samples used for gene expression using a previously validated grid of test lines projected onto the image and a custom macro linked to specialized software (ImagePro Plus; MediaCybernetics, Silver Spring, Md., USA). A grid of test lines of a known length was applied onto the image. The number of intercepts between these lines and tissue was counted with Lm calculated as the total length of the test lines divided by the number of cross-overs with tissue (equal to the number of intercepts divided by 2). The pattern of the group selected should be one that shows a change from a group of similar subjects that do not have COPD and/or emphysema. Preferably, the expression level overall for the group shows a pattern change, i.e. some genes overexpress, some underexpress. More preferably, the overally change is statistically significant.

TABLE 1

Emphysema/COPD Marker Genes which are Downregulated in Tissue with Emphysematous Damage

| Gene | Log2 Fold Change in Gene Expression/Unit Increase in Lm | Log2 Fold Change in Gene Expression between Least Diseased Tertile of Samples and Most Diseased Tertile of Samples | NCBI Reference No: | SEQ ID NO | Protein SEQ ID NOs: | Variant SEQ ID NOs: | Variant Protein SEQ ID NOs: |
|---|---|---|---|---|---|---|---|
| ITGB1 | −0.24 | −0.37 | NM_002211 | 1 | 128 | 253-254 | 379-380 |
| PAPSS2 | −0.50 | −0.65 | NM_004670 | 2 | 129 | 255 | 381 |
| WFDC1 | −0.41 | −0.53 | NM_021197 | 3 | 130 | N/A | N/A |
| NOSTRIN | −0.77 | −0.99 | NM_001039724 | 4 | 131 | 256-258 | 382-384 |
| NDEL1 | −0.25 | −0.32 | NM_001025579 | 5 | 132 | 259 | 385 |
| STARD13 | −0.30 | −0.39 | NM_178006 | 6 | 133 | 260-264 | 386-390 |
| NEDD9 | −0.49 | −0.63 | NM_006403 | 7 | 134 | 265-266 | 391-392 |
| ASRGL1 | −0.40 | −0.52 | NM_001083926 | 8 | 135 | 267 | 393 |
| EDNRB | −0.57 | −0.74 | NM_000115 | 9 | 136 | 268-270 | 394-396 |
| KLF13 | −0.24 | −0.31 | NM_015995 | 10 | 137 | N/A | N/A |
| STOM | −0.22 | −0.28 | NM_004099 | 11 | 138 | 271 | 397 |
| GPR4 | −0.41 | −0.52 | NM_005282 | 12 | 139 | N/A | N/A |
| TMEM2 | −0.41 | −0.53 | NM_001135820 | 13 | 140 | 272 | 398 |
| SYN2 | −0.31 | −0.40 | NM_133625 | 14 | 141 | 273 | 399 |
| MT1JP | −1.33 | −1.71 | NR_036677 | 15 | N/A | N/A | N/A |
| RTN4 | −0.23 | −0.29 | NM_020532 | 16 | 142 | 274-277 | 400-403 |
| PAG1 | −0.41 | −0.52 | NM_018440 | 17 | 143 | N/A | N/A |
| COL4A2 | −0.31 | −0.40 | NM_001846 | 18 | 144 | N/A | N/A |
| FCN3 | −0.62 | −0.80 | NM_003665 | 19 | 145 | 278 | 404 |
| ABTB2 | −0.15 | −0.20 | NM_145804 | 20 | 146 | N/A | N/A |
| STX12 | −0.34 | −0.44 | NM_177424 | 21 | 147 | N/A | N/A |
| ACVRL1 | −0.51 | −0.65 | NM_000020 | 22 | 148 | 279 | 405 |
| NES | −0.30 | −0.39 | NM_006617 | 23 | 149 | N/A | N/A |
| PLXNA2 | −0.35 | −0.45 | NM_025179 | 24 | 150 | N/A | N/A |
| PODXL | −0.47 | −0.60 | NM_001018111 | 25 | 151 | 280 | 406 |
| PECAM1 | −0.36 | −0.46 | NM_000442 | 26 | 152 | N/A | N/A |
| TACC1 | −0.27 | −0.34 | NM_001146216 | 27 | 153 | 281-282 | 407-408 |
| C13orf15 | −0.43 | −0.56 | NM_014059 | 28 | 154 | N/A | N/A |
| S100A8 | −0.96 | −1.24 | NM_002964 | 29 | 155 | N/A | N/A |
| ENG | −0.33 | −0.43 | NM_001114753 | 30 | 156 | 283 | 409 |
| TPST2 | −0.17 | −0.22 | NM_001008566 | 31 | 157 | 284 | 410 |
| KRT7 | −0.55 | −0.71 | NM_005556 | 32 | 158 | N/A | N/A |
| SYCP2L | −0.43 | −0.56 | NM_001040274 | 33 | 159 | N/A | N/A |
| MYH9 | −0.19 | −0.25 | NM_002473 | 34 | 160 | N/A | N/A |
| BTNL3 | −0.31 | −0.40 | NM_197975 | 35 | 161 | N/A | N/A |
| WNT2B | −0.32 | −0.41 | NM_004185 | 36 | 162 | 285 | 411 |
| PHLDB1 | −0.31 | −0.40 | NM_001144758 | 37 | 163 | 286-287 | 412-413 |
| CYP4Z1 | −0.35 | −0.45 | NM_178134 | 38 | 164 | N/A | N/A |
| SMAD6 | −0.67 | −0.86 | NM_005585 | 39 | 165 | 288 | 414 |
| PRKCE | −0.38 | −0.49 | NM_005400 | 40 | 166 | N/A | N/A |
| RCOR1 | −0.22 | −0.28 | NM_015156 | 41 | 167 | N/A | N/A |
| LUZP1 | −0.22 | −0.29 | NM_001142546 | 42 | 168 | 289 | 415 |
| HERC3 | −0.22 | −0.29 | NM_014606 | 43 | 169 | N/A | N/A |
| KIAA1432 | −0.20 | −0.26 | NM_020829 | 44 | 170 | 290-291 | 416-417 |

TABLE 1-continued

Emphysema/COPD Marker Genes which are Downregulated in Tissue with Emphysematous Damage

| Gene | Log2 Fold Change in Gene Expression/Unit Increase in Lm | Log2 Fold Change in Gene Expression between Least Diseased Tertile of Samples and Most Diseased Tertile of Samples | NCBI Reference No: | SEQ ID NO | Protein SEQ ID NOs: | Variant SEQ ID NOs: | Variant Protein SEQ ID NOs: |
|---|---|---|---|---|---|---|---|
| CUGBP2 | −0.20 | −0.26 | NM_001025077 | 45 | 171 | 292-294 | 418-420 |
| CRMP1 | −0.20 | −0.25 | NM_001014809 | 46 | 172 | 295 | 421 |
| S1PR1 | −0.48 | −0.62 | NM_001400 | 47 | 173 | N/A | N/A |
| GABARAPL1 | −0.32 | −0.41 | NM_031412 | 48 | 174 | N/A | N/A |
| HPCAL1 | −0.23 | −0.30 | NM_134421 | 49 | 175 | 296 | 422 |
| CSPG4 | −0.31 | −0.41 | NM_001897 | 50 | 176 | N/A | N/A |
| DBC1 | −0.65 | −0.83 | NM_014618 | 51 | 177 | N/A | N/A |
| RAI2 | −0.26 | −0.34 | NM_001172739 | 52 | 178 | 297-299 | 423-425 |
| KL | −0.37 | −0.48 | NM_004795 | 53 | 179 | N/A | N/A |
| STXBP6 | −0.41 | −0.53 | NM_014178 | 54 | 180 | N/A | N/A |
| COL4A1 | −0.33 | −0.43 | NM_001845 | 55 | 181 | N/A | N/A |
| TAL1 | −0.27 | −0.35 | NM_003189 | 56 | 182 | N/A | N/A |
| QKI | −0.27 | −0.35 | NM_006775 | 57 | 183 | 300-302 | 426-428 |
| ARHGEF10 | −0.34 | −0.44 | NM_014629 | 58 | 184 | N/A | N/A |
| CMTM8 | −0.31 | −0.39 | NM_178868 | 59 | 185 | N/A | N/A |
| FOXF1 | −0.24 | −0.31 | NM_001451 | 60 | 186 | N/A | N/A |
| TMBIM1 | −0.18 | −0.23 | NM_002152 | 61 | 187 | N/A | N/A |
| MAP2 | −0.43 | −0.55 | NM_001039538 | 62 | 188 | 303-305 | 429-431 |
| SH3BP5 | −0.32 | −0.41 | NM_001018009 | 63 | 189 | 306 | 432 |
| ATOH8 | −0.36 | −0.46 | NM_032827 | 64 | 190 | N/A | N/A |
| C1orf55 | −0.22 | −0.29 | NM_152608 | 65 | 191 | N/A | N/A |
| CTTNBP2NL | −0.28 | −0.36 | NM_018704 | 66 | 192 | N/A | N/A |
| LPHN2 | −0.48 | −0.62 | NM_012302 | 67 | 193 | N/A | N/A |
| VIPR1 | −0.65 | −0.84 | NM_001251882 | 68 | 194 | 307-310 | 433-436 |
| PKN1 | −0.29 | −0.37 | NM_213560 | 69 | 195 | 311 | 437 |
| ECHDC3 | −0.27 | −0.35 | NM_024693 | 70 | 196 | N/A | N/A |
| ADRB1 | −0.46 | −0.59 | NM_000684 | 71 | 197 | N/A | N/A |
| GPR133 | −0.28 | −0.35 | NM_198827 | 72 | 198 | N/A | N/A |
| KIAA1772 | −0.12 | −0.16 | NM_001142966 | 73 | 199 | N/A | N/A |
| PTPN12 | −0.26 | −0.34 | NM_001131009 | 74 | 200 | 312-313 | 438-439 |
| ZNF358 | −0.19 | −0.25 | NM_018083 | 75 | 201 | N/A | N/A |
| LRRC8A | −0.37 | −0.48 | NM_001127244 | 76 | 202 | 314-315 | 440-441 |
| MAOA | −0.44 | −0.57 | NM_000240 | 77 | 203 | N/A | N/A |
| EPAS1 | −0.32 | −0.41 | NM_001430 | 78 | 204 | N/A | N/A |
| TGFBR2 | −0.15 | −0.20 | NM_001024847 | 79 | 205 | 316 | 442 |

TABLE 2

Emphysema/COPD Marker Genes which are Upregulated in Tissue with Emphysematous Damage

| Gene | Log2 Fold Change in Gene Expression/Unit Increase in Lm | Log2 Fold Change in Gene Expression between Least Diseased Tertile of Samples and Most Diseased Tertile of Samples | NCBI Ref No: | SEQ ID NO: | Protein SEQ ID NOs: | Variant SEQ ID NOs: | Variant Protein SEQ ID NOs: |
|---|---|---|---|---|---|---|---|
| BCL11A | 0.29 | 0.37 | NM_022893 | 80 | 206 | 317-318 | 443-444 |
| CCR7 | 0.46 | 0.60 | NM_001838 | 81 | 207 | N/A | N/A |
| KIAA0125 | 0.61 | 0.79 | NM_014792 | OBSOLETE | N/A | N/A | N/A |
| CD79B | 0.16 | 0.21 | NM_001039933 | 82 | 208 | 319-320 | 445-446 |
| AMPD1 | 0.45 | 0.58 | NM_000036 | 83 | 209 | 321 | 447 |
| CES3 | 0.19 | 0.25 | NM_024922 | 84 | 210 | 322-323 | 448-449 |
| KLHDC6 | 0.25 | 0.32 | NM_207335 | 85 | 211 | N/A | N/A |
| ATP2C2 | 0.31 | 0.40 | NM_014861 | 86 | 212 | N/A | N/A |
| DHRS9 | 0.74 | 0.95 | NM_001142270 | 87 | 213 | 324-326 | 450-452 |
| FCRLA | 0.29 | 0.38 | NM_001184866 | 88 | 214 | 327-332 | 453-458 |
| CD22 | 0.34 | 0.44 | NM_001771 | 89 | 215 | 333-335 | 459-461 |
| RBP5 | 0.35 | 0.45 | NM_031491 | 90 | 216 | N/A | N/A |
| FAIM3 | 0.42 | 0.54 | NM_005449 | 91 | 217 | 336-337 | 462-463 |
| PRRX1 | 0.32 | 0.41 | NM_006902 | 92 | 218 | 338 | 464 |
| SLC45A3 | 0.31 | 0.40 | NM_033102 | 93 | 219 | N/A | N/A |
| IRF4 | 0.38 | 0.48 | NM_002460 | 94 | 220 | 339 | 465 |
| PNMAL1 | 0.26 | 0.33 | NM_001103149 | 95 | 221 | 340 | 466 |
| PRDM15 | 0.11 | 0.14 | NM_001040424 | 96 | 222 | 341 | 467 |
| PDGFRL | 0.31 | 0.40 | NM_006207 | 97 | 223 | N/A | N/A |
| ANKS1B | 0.20 | 0.26 | NM_152788 | 98 | 224 | 342-352 | 468-478 |
| TMEM200A | 0.25 | 0.33 | NM_052913 | 99 | 225 | N/A | N/A |
| TMEM9 | 0.17 | 0.22 | NM_016456 | 100 | 226 | N/A | N/A |
| C17orf76 | 0.21 | 0.27 | NM_001113567 | 101 | 227 | 353 | 479 |

TABLE 2-continued

Emphysema/COPD Marker Genes which are Upregulated in Tissue with Emphysematous Damage

| Gene | Log2 Fold Change in Gene Expression/Unit Increase in Lm | Log2 Fold Change in Gene Expression between Least Diseased Tertile of Samples and Most Diseased Tertile of Samples | NCBI Ref No: | SEQ ID NO: | Protein SEQ ID NOs: | Variant SEQ ID NOs: | Variant Protein SEQ ID NOs: |
|---|---|---|---|---|---|---|---|
| KLHL6 | 0.41 | 0.53 | NM_130446 | 102 | 228 | N/A | N/A |
| FOLH1 | 0.17 | 0.21 | NM_001193471 | 103 | 229 | 354-357 | 480-483 |
| CALB2 | 0.21 | 0.28 | NM_001740 | 104 | 230 | 358 | 484 |
| CD79A | 0.60 | 0.78 | NM_001783 | 105 | 231 | 359 | 485 |
| DMRT2 | 0.14 | 0.18 | NM_001130865 | 106 | 232 | 360-361 | 486-487 |
| CXCL13 | 0.90 | 1.17 | NM_006419 | 107 | 233 | N/A | N/A |
| UGT8 | 0.18 | 0.24 | NM_001128174 | 108 | 234 | 362 | 488 |
| SIGLEC6 | 0.30 | 0.38 | NM_001245 | 109 | 235 | 363-367 | 489-493 |
| MAN1C1 | 0.15 | 0.19 | NM_020379 | 110 | 236 | N/A | N/A |
| OSBPL3 | 0.19 | 0.24 | NM_015550 | 111 | 237 | 368-370 | 494-496 |
| MGC29506 | 0.48 | 0.61 | NM_016459 | 112 | 238 | N/A | N/A |
| UNQ6228 | 0.28 | 0.36 | XR_110905 | 113 | N/A | N/A | N/A |
| DERL3 | 0.30 | 0.39 | NM_001135751 | 114 | 239 | 371-372 | 497-498 |
| NOPE | 0.16 | 0.21 | NM_020962 | 115 | 240 | N/A | N/A |
| C5orf20 | 0.22 | 0.28 | NM_130848 | 116 | 241 | N/A | N/A |
| LOC130576 | 0.21 | 0.27 | NM_177964 | 117 | 242 | N/A | N/A |
| ZFYVE19 | 0.12 | 0.16 | NM_001077268 | 118 | 243 | N/A | N/A |
| CR2 | 0.44 | 0.57 | NM_001006658 | 119 | 244 | 373 | 499 |
| GPR110 | 0.74 | 0.96 | NM_153840 | 120 | 245 | 374 | 500 |
| C8orf34 | 0.38 | 0.49 | NM_052958 | 121 | 246 | 375 | 501 |
| SLC4A8 | 0.37 | 0.47 | NM_001039960 | 122 | 247 | 376 | 502 |
| FAM129C | 0.17 | 0.22 | NM_173544 | 123 | 248 | 377 | 503 |
| TMEM182 | 0.17 | 0.22 | NM_144632 | 124 | 249 | N/A | N/A |
| GPR110 | 0.69 | 0.88 | NM_153840 | 125 | 250 | 378 | 504 |
| RALGPS2 | 0.42 | 0.54 | NM_152663 | 126 | 251 | N/A | N/A |
| transcript 3782069, GenBank BC012036 | 0.20 | 0.25 | Genbank Ref No: BC012036 | 127 | 252 | N/A | N/A |

The gene names listed in Tables 1 and 2 are common names. NCBI Gene ID numbers for each of the genes listed in Tables 1 and 2 can be obtained by searching the "Gene" Database of the NCBI (available on the World Wide Web at http://www.ncbi.nlm.nih.gov/) using the common name as the query and selecting the first returned *Homo sapiens* gene.

In certain embodiments, the subject may be exhibiting a sign or symptom of emphysema. In certain embodiments, the subject may be asymptomatic or not exhibit a sign or symptom of emphysema, but can be at risk of developing emphysema to due exposure to tobacco smoke, pollutants, asbestos or other risk factors as described herein.

In some embodiments, the methods and assays described herein include (a) transforming the gene expression product into a detectable gene target; (b) measuring the amount of the detectable gene target; and (c) comparing the amount of the detectable gene target to an amount of a reference, wherein if the amount of the detectable gene target is statistically different from that of the amount of the reference level, the subject is identified as having emphysema or is in need of a treatment to reverse emphysematous tissue damage.

In some embodiments, the reference can be a level of expression of the marker gene product in a normal healthy subject with no symptoms or signs of emphysema. For example, a normal healthy subject has normal lung function, and/or is not diagnosed with emphysema and/or COPD, and/or has no history of smoking tobacco, and/or has not been exposed to asbestos or other environmental factors known to contribute to emphysema (e.g. smoke, dust, fires, etc.). In some embodiments, the reference can also be a level of expression of the marker gene product in a control sample, a pooled sample of control individuals or a numeric value or range of values based on the same. In some embodiments, the reference can also be a level of expression of the marker gene product in a tissue sample taken from undiseased lung tissue of the subject. In certain embodiments, wherein the progression of emphysematous tissue damage in a subject is to be monitored over time, the reference can also be a level of expression of the marker gene product in a tissue sample taken from lung tissue of the subject at an earlier date.

Marker Genes

In certain embodiments, the marker gene(s) are selected from the genes listed in Table 1 and/or Table 2. In certain embodiments, one or more marker genes are selected from the group consisting of ITGB1, NEDD9, ACVRL1, SMAD6 and TGFBR2. In tissue with emphysema or emphysematous tissue damage, the marker genes listed in Table 1 can be downregulated and those in Table 2 can be upregulated, e.g. for marker genes listed in Table 1, if the measured marker gene expression in a subject is lower as compared to a reference level of that marker gene's expression, then the subject is identified as having emphysema. Likewise, for marker genes listed in Table 2, if the measured marker gene expression in a subject is higher by as compared to a reference level of that marker gene's expression, then the subject is identified as having emphysema. Preferably, once looks at a statistically significant change. However, even if a few genes in a group do not differ from normal, a subject can be identified as having emphysema or at risk for developing emphysema if the overall change of the group shows a significant change, preferably a statistically significant change.

In certain embodiments marker genes in Table 2 are upregulated in tissue with emphysematous damage. If the level of a gene expression product of a marker gene in Table 2 is higher than a reference level of that marker gene, the subject is more likely to have emphysema or to be in need of a treatment for emphysema. The level of a gene expression product of a marker gene in Table 2 which is higher than a reference level of that marker gene by at least about 10% than the reference amount, at least about 20%, at least about 30%, at least about 40%, at least about 50%, at least about 80%, at least about 100%, at least about 200%, at least about 300%, at least about 500% or at least about 1000% or more, is indicative that the subject has emphysema or emphysematous damage.

In certain embodiments marker genes in Table 1 are downregulated in tissue with emphysematous damage. If the level of a gene expression product of a marker gene in Table 1 is lower than a reference level of that marker gene, the subject is more likely to have emphysema or to be in need of a treatment for emphysema. The level of a gene expression product of a marker gene in Table 1 which is lower than a reference level of that marker gene by at least about 10% than the reference amount, at least about 20%, at least about 30%, at least about 40%, at least about 50%, at least about 60%, at least about 70%, at least about 80%, at least about 90%, or at least about 95%, about 98%, about 99% or 100%, including all the percentages between 10-100% is indicative that the subject has emphysema or emphysematous damage.

In certain embodiments a subject is indicated to have emphysematous damage, and/or to have emphysema, and/or to be in need of treatment for emphysematous damage, and/or to be in need of treatment for COPD and/or emphysema, and/or to have an increased likelihood of having emphysema, and/or to have an increased likelihood of having a more severe case of emphysema if the expression level of one or more marker genes in a sample obtained from a subject differs from the expression level in a reference sample by a statistically significant amount.

In certain embodiments a sample is indicated to have emphysematous damage, and/or to have emphysema, and/or to be in need of treatment for emphysematous damage, and/or to be in need of treatment for COPD and/or emphysema, and/or to have an increased likelihood of having emphysema, and/or to have an increased likelihood of having a more severe case of emphysema if the log 2 fold change in expression level of one or more marker genes in a sample obtained from a patient as compared to the expression level in a reference sample is at least the amount indicated for those particular marker genes in the column labeled "Log 2 Fold Change in Gene Expression/Unit Increase in Lm" of Table 1 or Table 2. One looks at the overall changes in the group and if there is a change of 2 orders of magnitude for the entire group, the individual is identified as having a risk of emphysema, even if there is not a statistically significant change for a few of the individual genes.

In certain embodiments a subject is indicated to have emphysematous damage, and/or to have emphysema, and/or to be in need of treatment for emphysematous damage, and/or to be in need of treatment for COPD and/or emphysema, and/or to have an increased likelihood of having emphysema, and/or to have an increased likelihood of having a more severe case of emphysema if the log 2 fold change in expression level of one or more marker genes in a sample obtained from a patient as compared to the expression level in a reference sample is at least 50% of the amount indicated for those particular marker genes in the column labeled "Log 2 Fold Change in Gene Expression/Unit Increase in Lm" of Table 1 or Table 2. In certain embodiments a subject is indicated to have emphysematous damage, and/or to have emphysema, and/or to be in need of treatment for emphysematous damage, and/or to be in need of treatment for COPD and/or emphysema, and/or to have an increased likelihood of having emphysema, and/or to have an increased likelihood of having a more severe case of emphysema if the log 2 fold change in expression level of one or more marker genes in a sample obtained from a patient as compared to the expression level in a reference sample is at least 60% of the amount indicated for those particular marker genes in the column labeled "Log 2 Fold Change in Gene Expression/Unit Increase in Lm" of Table 1 or Table 2.

In certain embodiments a sample is indicated to have emphysematous damage, and/or to have emphysema, and/or to be in need of treatment for emphysematous damage, and/or to be in need of treatment for COPD and/or emphysema, and/or to have an increased likelihood of having emphysema, and/or to have an increased likelihood of having a more severe case of emphysema if the log 2 fold change in expression level of one or more marker genes in a sample obtained from a patient as compared to the expression level in a reference sample is at least the amount indicated for those particular marker genes in the column labeled "Log 2 Fold Change in Gene Expression between Least Diseased Tertile of Samples and Most Diseased Tertile of Samples" of Table 1 or Table 2.

Methods for Measuring Gene Expression Products Described Herein

As used herein, the term "transforming" or "transformation" refers to changing an object or a substance, e.g., biological sample, nucleic acid or protein, into another substance. The transformation can be physical, biological or chemical. Exemplary physical transformation includes, but not limited to, pre-treatment of a biological sample, e.g., from whole blood to blood serum by differential centrifugation. A biological/chemical transformation can involve at least one enzyme and/or a chemical reagent in a reaction. For example, a DNA sample can be digested into fragments by one or more restriction enzyme, or an exogenous molecule can be attached to a fragmented DNA sample with a ligase. In some embodiments, a DNA sample can undergo enzymatic replication, e.g., by polymerase chain reaction (PCR).

Methods to measure gene expression products associated with the marker genes described herein are well known to a skilled artisan. Such methods to measure gene expression products, e.g., protein level, include ELISA (enzyme linked immunosorbent assay), western blot, and immunoprecipitation, immunofluorescence using detection reagents such as an antibody or protein binding agents. Alternatively, a peptide can be detected in a subject by introducing into a subject a labeled anti-peptide antibody and other types of detection agent. For example, the antibody can be labeled with a radioactive marker whose presence and location in the subject is detected by standard imaging techniques.

For example, antibodies for ITGB1 (ab52971 AbCam Cambridge, Mass.) NEDD9 (ab18056 AbCam Cambridge, Mass.), ACVRL1 (ab74039 AbCam Cambridge, Mass.), SMAD6 (ab13727 AbCam Cambridge, Mass.), and TGFBR2 (ab61213 AbCam Cambridge, Mass.) are commercially available and can be used for the purposes of the invention to measure protein expression levels. Alternatively, since the amino acid sequences for the marker genes described herein are known and publically available at NCBI website, one of skill in the art can raise their own antibodies against these proteins of interest for the purpose of the invention.

The amino acid sequences of the marker genes described herein have been assigned NCBI accession numbers for different species such as human, mouse and rat. In particular, the NCBI accession numbers for the amino acid sequences of the human marker genes are included herein. For the human ITGB1 protein, the NCBI accession number for the amino acid sequence is NP_596867.1, NP_391988.1, or NP_002202.2 (due to the presence of three transcript variants). For the human NEDD9 protein, the NCBI accession number for the amino acid sequence is either NP_001135865.1, NP_006394.1 or NP_892011.2 (due to the presence of three transcript variants). For the human ACVRL1 protein, the NCBI accession number for the amino acid sequence is either NP_000011.2 or NP_001070869.1 (due to the presence of two transcript variants). For the human SMAD6 protein, the NCBI accession number for the amino acid sequence is NP_001136333.1 and NP_005576.3 (due to the presence of two transcript variants). For the human TGFBR2 protein, the NCBI accession number for the amino acid sequence is NP_001020018.1 or NP_003233.4 (due to the presence of two transcript variants).

In alternative embodiments, antibodies directed against peptides encoded by the gene of interest, for example an antibody against ACVRL1 (ab74039 AbCam Cambridge, Mass.) can also be used in the assays and methods described herein. Such diagnostic methods can be used to detect abnormalities in the level of expression of the peptide, or abnormalities in the structure and/or tissue, cellular, or subcellular location of the peptide.

In another embodiment, immunohistochemistry ("IHC") and immunocytochemistry ("ICC") techniques can be used. IHC is the application of immunochemistry to tissue sections, whereas ICC is the application of immunochemistry to cells or tissue imprints after they have undergone specific cytological preparations such as, for example, liquid-based preparations. Immunochemistry is a family of techniques based on the use of an antibody, wherein the antibodies are used to specifically target molecules inside or on the surface of cells. The antibody typically contains a marker that will undergo a biochemical reaction, and thereby experience a change color, upon encountering the targeted molecules. In some instances, signal amplification can be integrated into the particular protocol, wherein a secondary antibody, that includes the marker stain or marker signal, follows the application of a primary specific antibody.

In certain embodiments, the gene expression products as described herein can be instead determined by determining the level of messenger RNA (mRNA) expression of genes associated with the marker genes described herein. Such molecules can be isolated, derived, or amplified from a biological sample, such as a lung biopsy. Detection of mRNA expression is known by persons skilled in the art, and comprise, for example but not limited to, PCR procedures, RT-PCR, Northern blot analysis, differential gene expression, RNA protection assay, microarray analysis, hybridization methods etc.

The nucleic acid sequences of the marker genes described herein have been assigned NCBI accession numbers for different species such as human, mouse and rat. In particular, the NCBI accession numbers for the nuclei acid sequences of the human marker genes are included herein. For the human ITGB1 mRNA, the NCBI accession number for the nucleic acid sequence is NM_002211.3, NM_033668.2, or NM_133376.2 each of which represents a different transcript variant. For the human NEDD9 mRNA, the NCBI accession number for the nucleic acid sequence is either NM_182966.3, NM_006403.3, or NM_001142393.1, each of which represents a different transcript variant. For the human ACVRL1 mRNA, the NCBI accession number for the nucleic acid sequence is NM_001077401.1 or NM_000020.2, each of which represents a different transcript variant. For the human SMAD6 mRNA, the NCBI accession number for the nucleic acid sequence is NM_005585.4 or NM_001142861.2, each of which represents a different transcript variant. For the human TGFBR2 mRNA, the NCBI accession number for the nucleic acid sequence is NM_003242.5 or NM_001024847.2, each of which represents a different transcript variant. Accordingly, a skilled artisan can design an appropriate primer based on the known sequence for determining the mRNA level of the respective gene.

Nucleic acid and ribonucleic acid (RNA) molecules can be isolated from a particular biological sample using any of a number of procedures, which are well-known in the art, the particular isolation procedure chosen being appropriate for the particular biological sample. For example, freeze-thaw and alkaline lysis procedures can be useful for obtaining nucleic acid molecules from solid materials; heat and alkaline lysis procedures can be useful for obtaining nucleic acid molecules from urine; and proteinase K extraction can be used to obtain nucleic acid from blood (Roiff, A et al. PCR: Clinical Diagnostics and Research, Springer (1994)).

In general, the PCR procedure describes a method of gene amplification which is comprised of (i) sequence-specific hybridization of primers to specific genes within a nucleic acid sample or library, (ii) subsequent amplification involving multiple rounds of annealing, elongation, and denaturation using a DNA polymerase, and (iii) screening the PCR products for a band of the correct size. The primers used are oligonucleotides of sufficient length and appropriate sequence to provide initiation of polymerization, i.e. each primer is specifically designed to be complementary to each strand of the genomic locus to be amplified.

In an alternative embodiment, mRNA level of gene expression products described herein can be determined by reverse-transcription (RT) PCR and by quantitative RT-PCR (QRT-PCR) or real-time PCR methods. Methods of RT-PCR and QRT-PCR are well known in the art.

Systems for Identifying a Subject with Increased Risk for Having Emphysema or Needing Treatment for Emphysema In another embodiment of the assays described herein, the assay comprises or consists essentially of a system for transforming and measuring the amount of gene expression products of at least two marker genes as described herein and comparing them to a reference expression level. If the comparison system, which can be a computer implemented system, indicates that the amount of the measured gene expression product is statistically different from that of the reference amount, the subject from which the sample is collected can be identified as having an increased risk for having emphysema or for being in need of a treatment for emphysema.

Embodiments of the invention also provide for systems (and computer readable media for causing computer systems) to perform a method for assessing the state of the lungs of a subject by measuring the level of gene expression products of at least two marker genes selected from Table 1 and/or Table 2. In certain embodiments, one or more of the marker genes are selected from the group consisting of ITGB1, NEDD9, ACVRL1, SMAD6 and TGFBR2.

Figure 9:
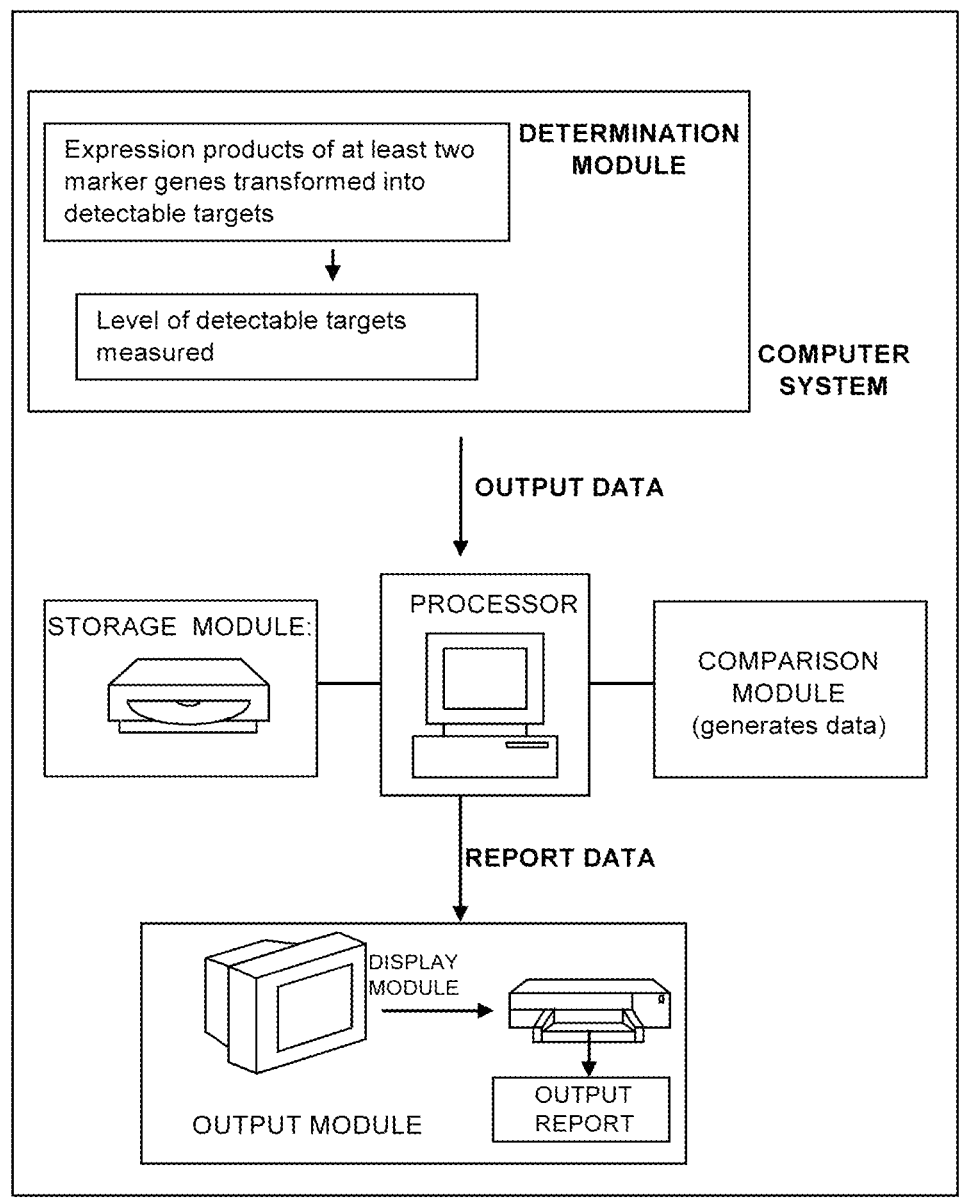
FIG. 9 is a diagram of an embodiment of a system for performing a method for assessing the state of the lungs in a subject.

In one embodiment, provided herein is a system comprising: (a) at least one memory containing at least one computer program adapted to control the operation of the computer system to implement a method that includes (i) a determination module configured to identify and detect at the expression level of at least two marker genes in a lung tissue sample obtained from a subject; (ii) a storage module configured to store output data from the determination module; (iii) a computing module adapted to identify from the output data whether the level of expression of at least two marker genes in the lung tissue sample obtained from a subject varies by a statistically significant amount from the expression level found in a reference sample and (iv) a display module for displaying whether two or more marker genes have a statistically significant variation in expression level in the lung tissue sample obtained from a subject as compared to the reference expression level and/or displaying the relative expression levels of the marker genes and (b) at least one processor for executing the computer program (see FIG. 9).

Embodiments of the invention can be described through functional modules, which are defined by computer executable instructions recorded on computer readable media and which cause a computer to perform method steps when executed. The modules are segregated by function for the sake of clarity. However, it should be understood that the modules/systems need not correspond to discreet blocks of code and the described functions can be carried out by the execution of various code portions stored on various media and executed at various times. Furthermore, it should be appreciated that the modules can perform other functions, thus the modules are not limited to having any particular functions or set of functions.

The computer readable storage media can be any available tangible media that can be accessed by a computer. Computer readable storage media includes volatile and nonvolatile, removable and non-removable tangible media implemented in any method or technology for storage of information such as computer readable instructions, data structures, program modules or other data. Computer readable storage media includes, but is not limited to, RAM (random access memory), ROM (read only memory), EPROM (erasable programmable read only memory), EEPROM (electrically erasable programmable read only memory), flash memory or other memory technology, CD-ROM (compact disc read only memory), DVDs (digital versatile disks) or other optical storage media, magnetic cassettes, magnetic tape, magnetic disk storage or other magnetic storage media, other types of volatile and non-volatile memory, and any other tangible medium which can be used to store the desired information and which can accessed by a computer including and any suitable combination of the foregoing.

Computer-readable data embodied on one or more computer-readable media may define instructions, for example, as part of one or more programs that, as a result of being executed by a computer, instruct the computer to perform one or more of the functions described herein, and/or various embodiments, variations and combinations thereof. Such instructions may be written in any of a plurality of programming languages, for example, Java, J#, Visual Basic, C, C#, C++, Fortran, Pascal, Eiffel, Basic, COBOL assembly language, and the like, or any of a variety of combinations thereof. The computer-readable media on which such instructions are embodied may reside on one or more of the components of either of a system, or a computer readable storage medium described herein, may be distributed across one or more of such components.

The computer-readable media may be transportable such that the instructions stored thereon can be loaded onto any computer resource to implement the aspects of the present invention discussed herein. In addition, it should be appreciated that the instructions stored on the computer-readable medium, described above, are not limited to instructions embodied as part of an application program running on a host computer. Rather, the instructions may be embodied as any type of computer code (e.g., software or microcode) that can be employed to program a computer to implement aspects of the present invention. The computer executable instructions may be written in a suitable computer language or combination of several languages. Basic computational biology methods are known to those of ordinary skill in the art and are described in, for example, Setubal and Meidanis et al., Introduction to Computational Biology Methods (PWS Publishing Company, Boston, 1997); Salzberg, Searles, Kasif, (Ed.), Computational Methods in Molecular Biology, (Elsevier, Amsterdam, 1998); Rashidi and Buehler, Bioinformatics Basics: Application in Biological Science and Medicine (CRC Press, London, 2000) and Ouelette and Bzevanis Bioinformatics: A Practical Guide for Analysis of Gene and Proteins (Wiley & Sons, Inc., 2nd ed., 2001).

The functional modules of certain embodiments of the invention include at minimum a determination module, a storage module, a computing module, and a display module. The functional modules can be executed on one, or multiple, computers, or by using one, or multiple, computer networks. The determination module has computer executable instructions to provide e.g., levels of expression products etc in computer readable form.

The determination module can comprise any system for detecting a signal elicited from the marker genes described herein in a biological sample. In some embodiments, such systems can include an instrument, e.g., StepOnePlus Real-Time PCR systems (Applied Biosystems) as described herein for quantitative RT-PCR. In another embodiment, the determination module can comprise multiple units for different functions, such as amplification and hybridization. In one embodiment, the determination module can be configured to perform the quantitative RT-PCR methods described in the Examples, including amplification, detection, and analysis. In some embodiments, such systems can include an instrument, e.g., the Cell Biosciences NanoPro 1000 System (Cell Biosciences) for quantitative measurement of peptides and/or proteins.

In some embodiments, the determination module can be further configured to identify and detect the presence of at least one additional emphysema related marker gene.

The information determined in the determination system can be read by the storage module. As used herein the "storage module" is intended to include any suitable computing or processing apparatus or other device configured or adapted for storing data or information. Examples of electronic apparatus suitable for use with the present invention include stand-alone computing apparatus, data telecommunications networks, including local area networks (LAN), wide area networks (WAN), Internet, Intranet, and Extranet, and local and distributed computer processing systems. Storage modules also include, but are not limited to: magnetic storage media, such as floppy discs, hard disc storage media, magnetic tape, optical storage media such as CD-ROM, DVD, electronic storage media such as RAM, ROM, EPROM, EEPROM and the like, general hard disks and hybrids of these categories such as magnetic/optical storage media. The storage module is adapted or configured for having recorded thereon, for example, sample name, alleleic variants, and frequency of each alleleic variant. Such information may be provided in digital form that can be transmitted and read electronically, e.g., via the Internet, on diskette, via USB (universal serial bus) or via any other suitable mode of communication.

As used herein, "stored" refers to a process for encoding information on the storage module. Those skilled in the art can readily adopt any of the presently known methods for recording information on known media to generate manufactures comprising expression level information.

In one embodiment of any of the systems described herein, the storage module stores the output data from the determination module. In additional embodiments, the storage module stores the reference information such as expression levels of the marker genes described herein in subjects who do not have symptoms associated with emphysema. In certain embodiments, the storage module stores the reference information such as expression levels of the marker genes described herein in a sample of healthy lung tissue obtained from the subject or in a sample from the subject taken at an earlier time.

Figure 10:
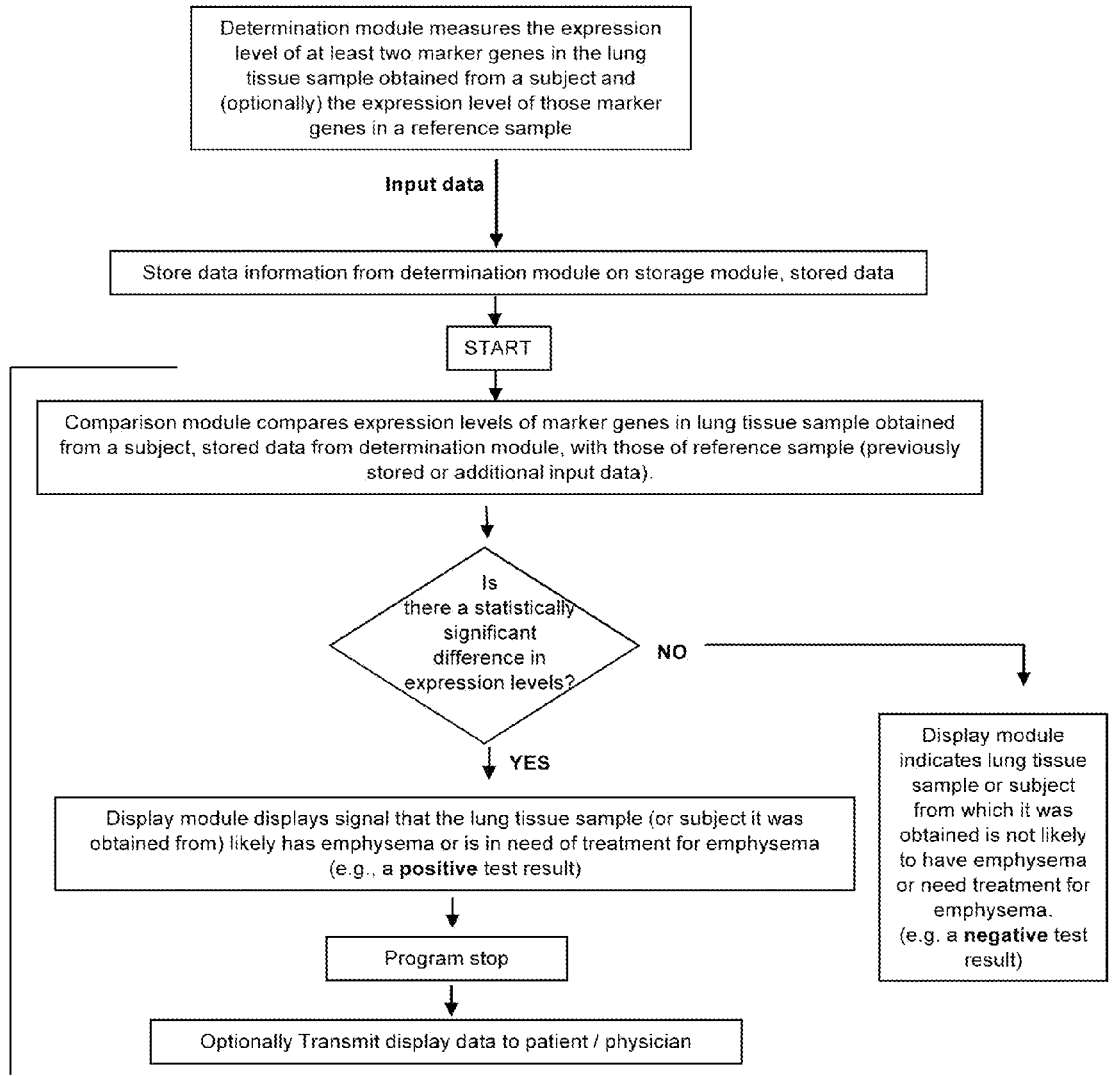
FIG. 10 is a diagram of an embodiment of a comparison module as described herein.

The "computing module" can use a variety of available software programs and formats for computing the relative expression level of the marker genes described herein. Such algorithms are well established in the art. A skilled artisan is readily able to determine the appropriate algorithms based on the size and quality of the sample and type of data. The data analysis tools described in Examples can be implemented in the computing module of the invention. In one embodiment, the computing module further comprises a comparison module, which compares the expression level of at least two markers genes in the lung tissue sample obtained from a subject as described herein with the reference expression level of those marker genes (FIG. 10). By way of an example, when the expression level of ACVRL1 in the lung tissue sample obtained from a subject is measured, a comparison module can compare or match the output data—with the reference expression level of ACVRL1 in a reference sample. In certain embodiments, the reference expression level can have been pre-stored in the storage module. During the comparison or matching process, the comparison module can determine whether the expression level in the lung tissue sample obtained from a subject is lower than the reference expression level to a statistically significant degree. In various embodiments, the comparison module can be configured using existing commercially-available or freely-available software for comparison purpose, and may be optimized for particular data comparisons that are conducted.

Figure 11:
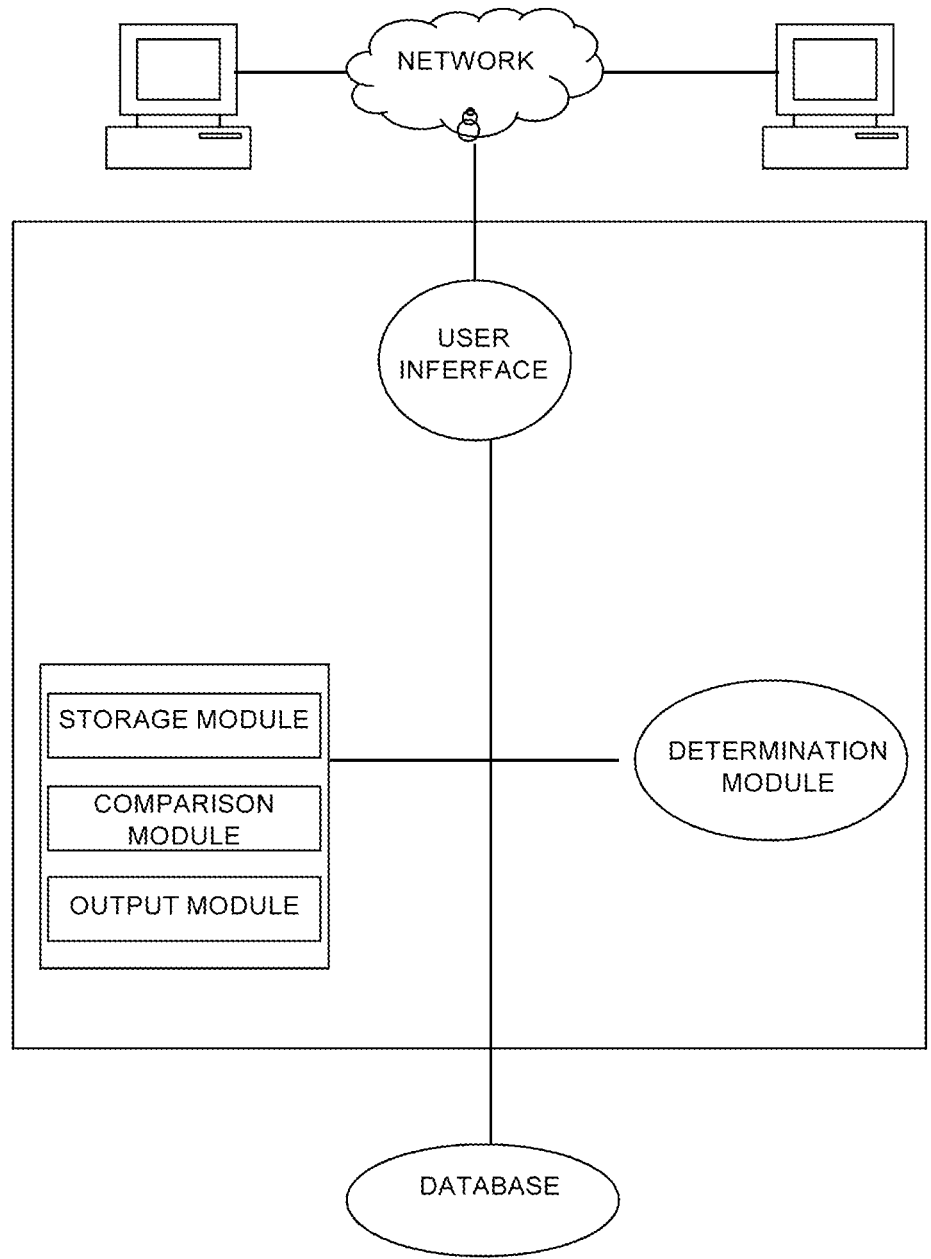
FIG. 11 is a diagram of an embodiment of an operating system and applications for a computing system as described herein.

The computing and/or comparison module, or any other module of the invention, can include an operating system (e.g., UNIX) on which runs a relational database management system, a World Wide Web application, and a World Wide Web server. World Wide Web application includes the executable code necessary for generation of database language statements (e.g., Structured Query Language (SQL) statements). Generally, the executables will include embedded SQL statements. In addition, the World Wide Web application may include a configuration file which contains pointers and addresses to the various software entities that comprise the server as well as the various external and internal databases which must be accessed to service user requests. The Configuration file also directs requests for server resources to the appropriate hardware—as may be necessary should the server be distributed over two or more separate computers. In one embodiment, the World Wide Web server supports a TCP/IP protocol. Local networks such as this are sometimes referred to as "Intranets." An advantage of such Intranets is that they allow easy communication with public domain databases residing on the World Wide Web (e.g., the GenBank or Swiss Pro World Wide Web site). Thus, in a particular preferred embodiment of the present invention, users can directly access data (via Hypertext links for example) residing on Internet databases using a HTML interface provided by Web browsers and Web servers (FIG. 11).

The computing and/or comparison module provides a computer readable comparison result that can be processed in computer readable form by predefined criteria, or criteria defined by a user, to provide content based in part on the comparison result that may be stored and output as requested by a user using an output module, e.g., a display module.

In some embodiments, the content displayed on the display module can be the relative expression levels of at least two marker genes in the lung tissue sample obtained from a subject as compared to a reference expression level. In certain embodiments, the content displayed on the display module can indicate whether at least two marker genes were found to have a statistically significant variation in expression between the lung tissue sample obtained from a subject as compared to a reference expression level. In certain embodiments, the content displayed on the display module can indicate the degree to which at least two marker genes were found to have a statistically significant variation in expression between the lung tissue sample obtained from a subject as compared to a reference expression level. In certain embodiments, the content displayed on the display module can indicate whether the subject has an increased risk of having emphysema. In certain embodiments, the content displayed on the display module can indicate whether the subject is in need of a treatment for emphysema. In certain embodiments, the content displayed on the display module can indicate whether the subject has an increased risk of having a more severe case of emphysema. In some embodiments, the content displayed on the display module can be a numerical value indicating one of these risk or probabilities. In such embodiments, the probability can be expressed in percentages or a fraction. For example, higher percentage or a fraction closer to 1 indicates a higher likelihood of a subject having emphysema. In some embodiments, the content displayed on the display module can be single word or phrases to qualitatively indicate a risk or probability. For example, a word "unlikely" can be used to indicate a lower risk for having emphysema, while "likely" can be used to indicate a high risk for having emphysema.

In one embodiment of the invention, the content based on the computing and/or comparison result is displayed on a computer monitor. In one embodiment of the invention, the content based on the computing and/or comparison result is displayed through printable media. The display module can be any suitable device configured to receive from a computer and display computer readable information to a user. Non-limiting examples include, for example, general-purpose computers such as those based on Intel PENTIUM-type processor, Motorola PowerPC, Sun UltraSPARC, Hewlett-Packard PA-RISC processors, any of a variety of processors available from Advanced Micro Devices (AMD) of Sunnyvale, Calif., or any other type of processor, visual display devices such as flat panel displays, cathode ray tubes and the like, as well as computer printers of various types.

In one embodiment, a World Wide Web browser is used for providing a user interface for display of the content based on the computing/comparison result. It should be understood that other modules of the invention can be adapted to have a web browser interface. Through the Web browser, a user can construct requests for retrieving data from the computing/comparison module. Thus, the user will typically point and click to user interface elements such as buttons, pull down menus, scroll bars and the like conventionally employed in graphical user interfaces.

Systems and computer readable media described herein are merely illustrative embodiments of the invention for assessing the state of the lungs of subject by measuring the expression level of at least two of the marker genes described herein, and therefore are not intended to limit the scope of the invention. Variations of the systems and computer readable media described herein are possible and are intended to fall within the scope of the invention.

The modules of the machine, or those used in the computer readable medium, may assume numerous configurations. For example, function may be provided on a single machine or distributed over multiple machines.

Lung Tissue Sample

Provided herein are methods, assays and systems for assessing the state of the lungs of a subject by measuring the expression level of at least two marker genes as described herein in the lung tissue sample obtained from a subject. The term "lung tissue sample" as used herein denotes a sample taken or isolated from a biological organism, e.g., lung biopsy sample, tissue cell culture supernatant, cell lysate, a homogenate of a tissue sample from a subject or a fluid sample from a subject. Exemplary biological samples include, but are not limited to, lung biopsies, the external sections of the respiratory tract, lung epithelial cells, etc. The term also includes both a mixture of the above-mentioned samples. The term "lung tissue sample" also includes untreated or pretreated (or pre-processed) biological samples. A lung tissue sample can contain cells from subject, but the term can also refer to non-cellular biological material, such as non-cellular fractions that can be used to measure gene expression levels. In some embodiments, the sample is from a resection, biopsy, or core needle biopsy. In addition, fine needle aspirate samples can be used. Samples can be either paraffin-embedded or frozen tissue.

The sample can be obtained by removing a sample of cells from a subject, but can also be accomplished by using previously isolated cells (e.g. isolated at a prior timepoint and isolated by the same or another person). In addition, the lung tissue sample can be freshly collected or a previously collected sample. Furthermore, the lung tissue sample can be utilized for the detection of the presence and/or quantitative level of a gene expression product of marker genes as described herein. In some embodiments, a maker gene expression product is a biomolecule. Representative biomolecules include, but are not limited to, DNA, RNA, mRNA, polypeptides, and derivatives and fragments thereof. In some embodiments, the lung tissue sample can be used for expression analysis for diagnosis of a disease or a disorder, e.g., emphysema, using the methods, assays and systems of the invention.

In some embodiments, lung tissue sample is a biological fluid. Examples of biological fluids include, but are not limited to, saliva, blood, sputum, an aspirate, and any combinations thereof.

In some embodiments, the lung tissue sample is an untreated lung tissue sample. As used herein, the phrase "untreated lung tissue sample" refers to a lung tissue sample that has not had any prior sample pre-treatment except for dilution and/or suspension in a solution. Exemplary methods for treating a lung tissue sample include, but are not limited to, centrifugation, filtration, sonication, homogenization, heating, freezing and thawing, and any combinations thereof.

In some embodiments, the lung tissue sample is a frozen lung tissue sample, e.g., a frozen tissue or fluid sample such as sputum. The frozen sample can be thawed before employing methods, assays and systems of the invention. After thawing, a frozen sample can be centrifuged before being subjected to methods, assays and systems of the invention.

In some embodiments, the lung tissue sample can be treated with at least one chemical reagent, such as a protease inhibitor. In some embodiments, the lung tissue sample is a clarified lung tissue sample, for example, by centrifugation and collection of a supernatant comprising the clarified lung tissue sample.

In some embodiments, a lung tissue sample is a pre-processed lung tissue sample, for example, supernatant or filtrate resulting from a treatment selected from the group consisting of centrifugation, filtration, sonication, homogenization, lysis, thawing, amplification, purification, restriction enzyme digestion ligation and any combinations thereof. In some embodiments, a lung tissue sample can be a nucleic acid product amplified after polymerase chain reaction (PCR). The term "nucleic acid" used herein refers to DNA, RNA, or mRNA.

In some embodiments, the lung tissue sample can be treated with a chemical and/or biological reagent. Chemical and/or biological reagents can be employed to protect and/or maintain the stability of the sample, including biomolecules (e.g., nucleic acid and protein) therein, during processing. One exemplary reagent is a protease inhibitor, which is generally used to protect or maintain the stability of protein during processing. In addition, or alternatively, chemical and/or biological reagents can be employed to release nucleic acid or protein from the sample.

The skilled artisan is well aware of methods and processes appropriate for pre-processing of biological samples required for determination of expression of gene expression products as described herein.

Assays for Identifying Compounds Useful in Treating COPD and/or Emphysema

As described herein, the inventors have identified certain genes which are upregulated or downregulated to a statistically significant degree in tissue which is subject to emphysematous tissue damage as compared to a reference sample. Accordingly, some embodiments of the invention are generally related to assays, methods and systems for assessing whether a compound can be useful in treating or preventing the progression of COPD, emphysema and/or emphysematous damage (i.e. it causes gene regulation changes opposed to those caused by emphysematous tissue damage or prevents the gene regulation changes caused by emphysematous tissue damage).

In certain embodiments, the assays, methods and systems relate to identifying a compound which causes a change in the expression level of two or more marker genes in a healthy biological sample (i.e. a sample not exhibiting any signs or symptoms of emphysematous damage, or obtained from a patient not diagnosed with emphysema and/or COPD, etc) which is opposed to the type of change (i.e. upregulation or downregulation) observed in tissue suffering from emphysematous damage, as described elsewhere herein. In certain embodiments, the expression level of a gene product of at least two marker genes in a biological sample of a subject, i.e. at least two marker genes, or at least three marker genes, or at least four marker genes or at least five marker genes etc, selected from any in a combination of Table 1 and Table 2 as described herein, in response to a compound are determined. In some embodiments, the marker genes are selected from the group consisting of ITGB1, NEDD9, ACVRL1, SMAD6 and TGFBR2. In certain embodiments, the assays, methods and systems are directed to determination of the expression level of a gene product (e.g. protein and/or gene transcript such as mRNA) in a biological sample which has been treated with a compound.

In some embodiments, the methods and assays described herein include (a) transforming the gene expression product into a detectable gene target; (b) measuring the amount of the detectable gene target; and (c) comparing the amount of the detectable gene target to an amount of a reference, wherein if the amount of the detectable gene target is statistically different from that of the amount of the reference level, and the type of difference in expression level (i.e. upregulation or downregulation) is opposed to that observed for tissue suffering from emphysematous damage versus a reference level, the compound is identified as being useful in the treatment of COPD and/or emphysema.

In certain embodiments, the assays, methods and systems relate to identifying a compound which prevents, decreases, or reverses the change in the expression level of two or more marker genes which is observed in a biological sample suffering from emphysematous damage. In certain embodiments, the expression level of a gene product of at least two marker genes in a biological sample of a subject, i.e. at least two marker genes, or at least four marker genes, or at least five marker genes, or at least eight marker genes, or at least ten marker genes, or at least fifteen marker genes or at least twenty marker genes etc, selected from any in a combination of Table 1 and Table 2 as described herein, in response to a compound are determined. In some embodiments, the marker genes are selected from a combination of the genes from Table 1 and Table 2, for example, at least two genes from Table 1 and at least two genes from Table 2. In one embodiment, the genes are from the group consisting of ITGB1, NEDD9, ACVRL1, SMAD6 and TGFBR2. In certain embodiments, the assays, methods and systems are directed to determination of the expression level of a gene product (e.g. protein and/or gene transcript such as mRNA) in a biological sample which has been treated with a compound.

In some embodiments, the methods and assays described herein include (a) transforming the gene expression product in 1) a sample suffering from emphysematous damage and contacted with a compound and 2) a sample suffering from emphysematous damage into detectable gene targets; (b) measuring the amount of the detectable gene targets; and (c) comparing the amount of the detectable gene targets to an amount of a reference tissue, wherein if the amount of the detectable gene target in the sample contacted with the compound is less statistically different from that of the amount of the reference level than the amount of the detectable gene target in the sample not contacted with the compound, the compound is identified as being useful in the treatment of COPD and/or emphysema.

In some embodiments, the reference can be a level of expression of the marker gene product in a normal healthy subject with no symptoms or signs of emphysema. For example, a normal healthy subject has normal lung function, and/or is not diagnosed with emphysema and/or COPD, and/or has no history of smoking tobacco, and/or has not been exposed to asbestos or other environmental factors known to contribute to emphysema (e.g. smoke, dust, fires, etc.). In some embodiments, the reference can also be a level of expression in cultured cells or cultured lung cells. In some embodiments, the reference can also be a level of expression of the marker gene product in a control sample, a pooled sample of control individuals or samples or a numeric value or range of values based on the same. In some embodiments, the reference can also be a level of expression of the marker gene product in a tissue sample taken from undiseased lung tissue of a subject. In certain embodiments, wherein the progression of emphysematous tissue damage in a sample is to be monitored over time, the reference can also be a level of expression of the marker gene product in a tissue sample taken at an earlier date.

In certain embodiments, the marker gene(s) are selected from the genes listed in Table 1 and/or Table 2. In certain embodiments, the marker genes are selected from any in a combination of Table 1 and Table 2. In some embodiments, the marker genes are selected from a combination of the genes from Table 1 and Table 2, for example, at least two genes from Table 1 and at least two genes from Table 2. In one embodiment, the genes are from the group consisting of ITGB1, NEDD9, ACVRL1, SMAD6 and TGFBR2.

In some embodiments, the methods for measuring gene expression are as described elsewhere herein. In some embodiments, there are provided systems for performing the assays described herein. Examples of such systems are described in detail elsewhere herein.

Biological Sample

As used in the context of assays, methods, and systems to identify compounds useful in treating or preventing COPD, emphysema and/or emphysematous damage the term "biological sample" as used herein denotes a sample of taken or isolated from 1) a biological organism, e.g., lung biopsy sample, tissue cell culture supernatant, cell lysate, a homogenate of a tissue sample from a subject or a fluid sample from a subject or 2) an ex vivo cell, tissue, or population of cells, e.g. cells, a cell, tissue culture supernatant, lysate cell lysate, homogenized tissue, etc. Exemplary biological samples include, but are not limited to, lung biopsies, the external sections of the respiratory tract, lung epithelial cells, cultured lung epithelial cells, etc. The term also includes a mixture of the above-mentioned samples. The term "biological sample" also includes untreated or pre-treated (or pre-processed) biological samples. A biological sample can contain cells, but the term can also refer to non-cellular biological material, such as non-cellular fractions that can be used to measure gene expression levels. In some embodiments, the sample is from a resection, biopsy, or core needle biopsy. In addition, fine needle aspirate samples can be used. Samples can be either paraffin-embedded or frozen tissue.

The sample can be obtained by removing a sample of cells from a subject, but can also be accomplished by using previously isolated cells (e.g. isolated at a prior timepoint and isolated by the same or another person). In addition, the biological sample can be freshly collected or a previously collected sample. Furthermore, the biological sample can be utilized for the detection of the presence and/or quantitative level of a gene expression product of marker genes as described herein. In some embodiments, a maker gene expression product is a biomolecule. Representative biomolecules include, but are not limited to, DNA, RNA, mRNA, polypeptides, and derivatives and fragments thereof.

In some embodiments, biological sample is a biological fluid. Examples of biological fluids include, but are not limited to, saliva, blood, sputum, an aspirate, and any combinations thereof.

In some embodiments, the biological sample is an untreated lung tissue sample. As used herein, the phrase "untreated biological sample" refers to a biological sample that has not had any prior sample pre-treatment except for dilution and/or suspension in a solution. Exemplary methods for treating a biological sample include, but are not limited to, centrifugation, filtration, sonication, homogenization, heating, freezing and thawing, and any combinations thereof.

In some embodiments, the biological sample is a frozen biological sample, e.g., a frozen tissue or fluid sample such as sputum. The frozen sample can be thawed before employing methods, assays and systems of the invention. After thawing, a frozen sample can be centrifuged before being subjected to methods, assays and systems of the invention.

In some embodiments, the biological sample can be treated with at least one chemical reagent, such as a protease inhibitor. In some embodiments, the biological sample is a clarified biological sample, for example, by centrifugation and collection of a supernatant comprising the clarified biological sample.

In some embodiments, a biological sample is a pre-processed biological sample, for example, supernatant or filtrate resulting from a treatment selected from the group consisting of centrifugation, filtration, sonication, homogenization, lysis, thawing, amplification, purification, restriction enzyme digestion ligation and any combinations thereof. In some embodiments, a biological sample can be a nucleic acid product amplified after polymerase chain reaction (PCR). The term "nucleic acid" used herein refers to DNA, RNA, or mRNA.

In some embodiments, the biological sample can be treated with a chemical and/or biological reagent. Chemical and/or biological reagents can be employed to protect and/or maintain the stability of the sample, including biomolecules (e.g., nucleic acid and protein) therein, during processing. One exemplary reagent is a protease inhibitor, which is generally used to protect or maintain the stability of protein during processing. In addition, or alternatively, chemical and/or biological reagents can be employed to release nucleic acid or protein from the sample.

The skilled artisan is well aware of methods and processes appropriate for pre-processing of biological samples required for determination of expression of gene expression products as described herein.

Contacting a Biological Sample with a Compound

Provided herein, assays, methods and systems for assessing whether a compound can be useful in treating or preventing the progression of COPD, emphysema and/or emphysematous damage. In some embodiments, these aspects of the invention involve contacting a biological sample with a compound. A biological sample can be contacted with a compound at any time prior to transforming the gene expression product into a detectable gene target. For example, the biological sample can be contacted with the compound 1 minute prior to transformation, 30 minutes prior to transformation, 1 hour prior to transformation, 12 hours prior to transformation, 1 day prior to transformation, 1 week prior to transformation, 1 month prior to transformation, or more.

In some embodiments, a biological sample can be contacted with a compound once. In some embodiments, a biological sample can be contacted with a compound repeatedly. In some embodiments, a biological sample can be contacted with a combination of two or more compounds. In some embodiments, one or more compounds can be compounds which have not been identified as useful in treating COPD, emphysema and/or emphysematous damage and one or more compounds can be compounds which have previously been identified as useful or used to treat COPD, emphysema, and/or emphysematous damage.

In some embodiments, a subject can be contacted with a compound and a biological sample is subsequently obtained from the subject for use in a assay, method, or system as described herein. In some embodiments, a biological sample is obtained from a subject and subsequently contacted with a compound. In some embodiments, the biological sample contacted with a compound is not obtained directly from a subject, e.g. the biological sample comprises cultured cells.

In some embodiments, a compound can be a hormone, enzyme, cell, gene silencing molecule, inhibitor of an enzyme, small molecule, peptide, protein, nucleotide, antibody, antibody fragment, growth factor, virus, and/or bacterium.

Some embodiments of the present invention can be defined as any of the following numbered paragraphs.

What is claimed herein is:

1. A method for treating chronic obstructive pulmonary disorder (COPD) or emphysema in a subject by administering to the subject a composition comprising a GHK tripeptide.

2. A method for treating chronic obstructive pulmonary disorder (COPD) or emphysema in a subject comprising:
   (a) determining if a subject has or is at risk for COPD or emphysema; and
   (b) administering an effective amount of a composition comprising a GHK tripeptide if the individual is positive in step (a).

3. The method of Paragraph 1, further comprising performing an assay prior to administering the GHK tripeptide, the assay comprising;
   subjecting a test sample of a subject to at least one analysis to determine the level of expression of at least 2 marker gene products from at least 1 of the following 2 groups,
   Group A, wherein Group A is selected from the group consisting of:
   SEQ ID NOs: 1-79, 128-205, 253-316, and 379-442.
   Group B, wherein Group B is selected from the group consisting of:
   SEQ ID NOs: 80-127, 206-252, 317-378, and 443-504.
   wherein an expression profile of 2 or more marker gene products of Group A which is decreased relative to a reference level and an expression profile of 2 or more marker gene products of Group B which is increased relative to a reference level, indicates the presence of emphysema.

4. The method of Paragraph 4, further comprising administering the GHK tripeptide if the presence of emphysema is indicated.

5. The method of Paragraph 4, further comprising not administering the GHK tripeptide if the presence of emphysema is not indicated.

6. The use of a GHK peptide in the manufacture of a medicament for the treatment of emphysema or COPD.

7. The use of a pharmaceutical composition comprising a GHK tripeptide for the treatment of COPD or emphysema.

8. A method of reversing emphysematous lung destruction in a subject by contacting the lung with a GHK tripeptide.

9. The method or use of any of paragraphs 1-8, wherein the composition or medicament further comprises a pharmaceutically acceptable carrier.

10. The method or use of any of paragraphs 1-9, wherein the composition or medicament is administered to the airspace of the lung.
11. The method or use of paragraph 10, wherein the composition or medicament is administered orally or nasally.
12. The method or use of paragraph 10-11 wherein the composition or medicament is administered using an inhaler or a nebulizer.
13. The method or use of any of paragraphs 1-12, wherein the GHK is not complexed with copper.
14. The method or use of any of paragraphs 1-13 wherein the subject is a mammal.
15. The method or use of paragraph 14, wherein the subject is a human.
16. The method or use of any of paragraphs 1-14, wherein the subject is at risk of developing COPD.
17. The method or use of any of paragraphs 1-16, wherein the method further comprises selecting a subject in need of reversal of emphysematous lung destruction prior to contacting the lung tissue of the subject with the composition.
18. The method or use of any of paragraphs 1-17, wherein the subject smokes tobacco.
19. The method or use of any of paragraphs 1-18, wherein the subject has been exposed to asbestos, air pollution, or environmental hazards such as dust, chemicals, fires, and/or smoke.
20. The method or use of any of paragraphs 1-19, wherein the subject has low levels of α-1 antitrypsin (AAT) in the blood.
21. The method or use of any of paragraphs 1-20, wherein the subject is administered an additional treatment for emphysema or COPD.
22. The method or use of any of Paragraphs 1-21, wherein the additional treatment for emphysema or COPD is selected from the group consisting of:
a bronchodilator; albuterol; ipratropium bromide; methylxanthine; steroids; antibiotics; and oxygen.
23. An assay for assessing the state of the lungs of a subject, the assay comprising:
subjecting a test sample of a subject to at least one analysis to determine the level of expression of at least 2 marker gene products from at least 1 of the following 2 groups,
Group A, wherein Group A is selected from the group consisting of:
SEQ ID NOs: 1-79, 128-205, 253-316, and 379-442.
Group B, wherein Group B is selected from the group consisting of:
SEQ ID NOs: 80-127, 206-252, 317-378, and 443-504.
wherein an expression profile of 2 or more marker gene products of Group A which is decreased relative to a reference level and an expression profile of 2 or more marker gene products of Group B which is increased relative to a reference level, indicates the presence of emphysema.
24. The assay of Paragraph 23, wherein the expression profile is determined for at least three gene products of Group A and at least three gene products from Group B.
25. The assay of any of Paragraphs 23-24, wherein the expression profile is determined for at least 2 of the following 5 genes;
ITGB1, NEFF9, ACVRL1, SMAD6 and TGFBR2.
26. The assay of any of Paragraphs 23-25, wherein the expression profile is determined for at least 3 of the following 5 genes;
ITGB1, NEFF9, ACVRL1, SMAD6 and TGFBR2.
27. The assay of any of Paragraphs 23-26, wherein the expression profile is determined for at least 4 of the following 5 genes;
ITGB1, NEFF9, ACVRL1, SMAD6 and TGFBR2.
28. The assay of any of Paragraphs 23-27, wherein the expression profile is determined for the following 5 genes;
ITGB1, NEFF9, ACVRL1, SMAD6 and TGFBR2.
29. The assay of any of Paragraphs 23-28, further comprising;
wherein the subject is administered a treatment for emphysema or COPD if the expression profile of 2 or more marker gene products of Group A is decreased relative to a reference level and the expression profile of 2 or more marker gene products of Group B is increased relative to a reference level; or
wherein the subject is not administered a treatment for emphysema or COPD if the expression profile of 2 or more marker gene products of Group A is not decreased relative to a reference level and the expression profile of 2 or more marker gene products of Group B is not increased relative to a reference level.
30. The assay of Paragraph 29, wherein the treatment for emphysema or COPD is selected from the group consisting of:
a GHK tripeptide; a bronchodilator; albuterol; ipratropium bromide; methylxanthine; steroids; antibiotics; and oxygen.
31. The assay of Paragraph 29, wherein the treatment for emphysema or COPD comprises administering a GHK tripeptide according the methods of any of paragraphs 1-22.
32. The assay of any of Paragraphs 23-28, wherein a statistically significant difference in expression levels of at least two marker genes beyond a predetermined threshold identifies a subject with severe emphysema.
33. The assay of any of Paragraphs 23-28 and 32, wherein a subject indicated to have emphysema present in their lungs is administered a GHK tripeptide according to the methods of any of paragraphs 1-22.
34. The assay of any of Paragraphs 23-33, wherein the level of expression of a marker gene product is determined using an method selected from the group consisting of:
RT-PCR; quantitative RT-PCR; Northern blot; microarray based expression analysis; Western blot; immunoprecipitation; enzyme-linked immunosorbent assay (ELISA); radioimmunological assay (RIA); sandwich assay; fluorescence in situ hybridization (FISH); immunohistological staining; radioimmunometric assay; immunofluorescence assay; mass spectroscopy and immunoelectrophoresis assay.
35. A computer system for detecting emphysema in subject, the system comprising:
a determination module configured to identify and detect the expression level of at least four marker gene products in a lung tissue sample obtained from a subject, wherein at least two marker gene products are selected from the group consisting of SEQ ID NOs: 1-79, 128-205, 253-316, and 379-442 and at least two marker gene products are selected from the group consisting of SEQ ID NOs: 80-127, 206-252, 317-378, and 443-504;
a storage module configured to store output data from the determination module;
a comparison module adapted to identify from the output data whether the overall level of expression of the at least four marker genes in the lung tissue sample obtained from a subject varies by a statistically significant amount from the expression level found in a reference sample;
a display module for displaying whether two or more marker gene products have a statistically significant variation in expression level in the lung tissue sample obtained from a subject as compared to the reference expression level and/or displaying the relative expression levels of the marker gene products.

36. The system of paragraph 35 wherein two or more of the marker genes is selected from the group consisting of ITGB1, NEFF9, ACVRL1, SMAD6 and TGFBR2.

37. The system of any of paragraphs 35-36, wherein if the computing module determines that the overall expression level of the at least four marker genes in the lung tissue sample obtained from a subject varies by a statistically significant amount from the reference expression level, the display module displays a signal indicating that the expression levels in the sample obtained from a subject vary from those of the reference expression level.

38. The system of any of paragraphs 35-37, wherein the signal indicates that the subject has an increased likelihood of having emphysema.

39. The system of any of paragraphs 35-38, wherein the signal indicates the subject is in need of treatment for emphysema.

40. The system of any of paragraphs 35-39, wherein the signal indicates the degree to which the expression level of the marker genes in the sample obtained from a subject vary from the reference expression level.

41. The system of any of paragraph 35-40, wherein the signal indicates that the subject has an increased likelihood of having a more severe case of emphysema.

42. An assay for identifying a compound which can be used in treating COPD and/or emphysema, the assay comprising:
using a biological sample containing at least four marker gene products, wherein at least two of the gene products are from the group consisting of SEQ ID NOs: 1-504;
measuring the expression level of the marker genes;
comparing the expression level of the marker genes from the biological sample treated with the compound to reference levels the marker genes;
wherein the reference levels are obtained from a biological sample not treated with the compound;
wherein an overall statistically significant difference in the expression levels of the four marker genes in the biological sample treated with the compound relative to the reference levels indicates the compound can be used in treating COPD and/or emphysema.

The present invention is further illustrated by the following examples which in no way should be construed as being further limiting, The contents of all cited references, including literature references, issued patents, published patent applications, and co-pending patent applications, cited throughout this application are hereby expressly incorporated by reference.

The present invention has been described in terms of particular embodiments found or proposed by the present inventor to comprise preferred modes for the practice of the invention. It will be appreciated by those of skill in the art that, in light of the present disclosure, numerous modifications and changes can be made in the particular embodiments exemplified without departing from the intended scope of the invention. For example, due to codon redundancy, changes can be made in the underlying DNA sequence without affecting the protein sequence. Moreover, due to biological functional equivalency considerations, changes can be made in protein structure without affecting the biological action in kind or amount. All such modifications are intended to be included within the scope of the appended claims.

EXAMPLES

Described herein are experiments which correlate gene expression changes with the degree of emphysematous lung damage caused by COPD and/or emphysema. These studies have identified marker genes which are subject to statistically significant up- or down-regulation in lung tissue suffering emphysematous damage as compared to undamaged or less damaged tissue. Also described herein is work which identifies GHK as a compound which induces gene expression changes which are the opposite of those observed in tissue suffering from emphysematous lung damage. As shown herein, GHK causes these gene expression changes in human lung fibroblasts and is identified as a compound for treating COPD and/or emphysema and/or reversing emphysematous lung damage.

Example 1

Materials and Methods

Sample Acquisition and Processing

Single lungs (n=6) were removed from patients treated for severe COPD by double lung transplantation at the University of Pennsylvania and donor lungs (n=2) for which no suitable recipient was identified were released from the Gift of Life Organ Procurement Organization in Philadelphia. Each lung was removed from the thorax, cooled to 1.6° C., and transported to the laboratory where the bronchial stump was cannulated (Choong, et al., J Thorac Cardiovasc Surg 2005 130: 922-3). The lung was then inflated using a compressed air source attached to an underwater seal to slowly increase transpulmonary pressure (PL) from 0 to 30 cm $H_2O$. The specimen was then held at PL of 10 cm $H_2O$ while frozen by liquid nitrogen vapor (−130° C.). The frozen specimen had a MDCT scan and followed by being cut into 2 cm thick slices in the same plane as the CT scan. Tissue samples were collected using a sharpened steel cylinder (cork bore diameter: 14 mm). One sample from a cluster of four core samples of lung obtained from each site was processed for micro CT a companion core was used for the gene profiling and validation studies reported here.

The severity of emphysema within each core was estimated by measuring the mean linear intercept (Lm) by micro-CT. The micro-CT scan of each 2 cm long core provided approximately 1000 contiguous 4 μm thick images. Lm was measured from these images at 20 regular intervals along the 2 cm length of the core.

Measurement of Mean Linear Intercept

Mean linear intercept (Lm) was measured at 20 regularly spaced intervals of each of the microCT scans of lung samples adjacent to samples used for gene expression using a previously validated grid of test lines projected onto the image and a custom macro linked to specialized software (ImagePro Plus; MediaCybernetics, Silver Spring, Md., USA). A grid of test lines of a known length was applied onto the image. The number of intercepts between these lines and tissue was counted with Lm calculated as the total length of the test lines divided by the number of cross-overs with tissue (equal to the number of intercepts divided by 2).

Microarray Sample Processing

High molecular weight (Hmw; mRNA-containing fraction) RNA was isolated from tissue cores using the miRNeasy Mini Kit (Qiagen). The RNA integrity was assessed using an Agilent 2100 Bioanalyzer and RNA purity was assessed using a NanoDrop spectrophotometer. One µg of RNA was processed and hybridized onto the Human Exon 1.0 ST array (Affymetrix Inc., Santa Clara, Calif.) according to the manufacturer's protocol as previously described (Zhang, X. et al. Genome informatics. International Conference on Genome Informatics 2007 18:247-57).

Data Preprocessing

Expression Console Version 1.0 (Affymetrix Inc., Santa Clara, Calif.) was used to generate transcript-level gene expression estimates for the "core" exon probe sets via the robust multichip average (RMA) algorithm. Gene symbols of transcript ids were retrieved using DAVID (http://david.abcc.ncifcrf.gov/)28. These gene expression data are freely available through the Gene Expression Omnibus (GEO) (available at the world wide web address, ncbi.nlm.nih.gov/geo/) under the accession GSE27597.

Microarray Data Analysis

Linear mixed-effects models were used to identify gene expression profiles associated with the degree of regional emphysema severity as measured by Lm while correcting for the slice in the lung from which the core was taken and treating differences between patients as random effects.

Microarray and Immunohistochemistry Data Analysis

Two linear mixed-effects models were used to identify gene expression profiles associated with the degree of regional emphysema severity as measured by Lm:

$$\text{Gene}_{ij} = \beta_0 + \beta_{slice} * \text{Slice}_i + \alpha_j + \epsilon_{ij} \quad (1)$$

$$\text{Gene}_{ij} = \beta_0 + \beta_{slice} * \text{Slice}_i + \beta_{Lm} * \text{Lm}_i + \alpha_j + \epsilon_{ij} \quad (2)$$

$i=1, 2, \ldots, 8; j=1, 2, \ldots, 8$
$\epsilon_{ij} \sim N(0, \sigma^2) \; \alpha_j \sim N(0, \sigma^2_{aj})$ $\text{Gene}_{ij}$ is the log 2 expression value for sample i in patient j for a single gene. Slice is a fixed effect controlling for the position within the lung from which the sample core was obtained. The random term $\epsilon_i$, represents the random error which was assumed to be normally distributed, represents the random effect for patient, and $\beta_0$ represents the intercept. The model in equation (2) contains an additional fixed effect term for emphysema severity measured by the natural log of Lm. A gene's expression profile was considered associated with Lm if model (2) fit better than model (1) as determined by a significant p-value from an ANOVA between the two models after applying a false discovery rate (FDR) correction. In the immunohistochemistry experiments, these linear models were also used to examine the relationship between Lm and the volume fraction of tissue with positive staining by substituting volume fraction (Vv) for gene expression as a dependent variable.

Reverse Engineering of Transcriptional Networks

CLR scores between all possible pairs of genes were computed using CLR version 1.2, and a significance cut-off of FDR q-value $<2.0 \times 10^{-5}$ was selected. The CLR algorithm calculates these scores by computing mutual information between all possible pairs of genes and then applying a z-score correction. A sub-network was created consisting of edges between differentially expressed transcription factors and genes connected to these transcription factors and edges between non-differentially expressed transcription factors connected to differentially expressed genes (FIGS. 2A-2C). The direction of the correlation was determined by the sign of a Pearson correlation.

Connecting to Other Datasets

GSEA was used to explore connections to other datasets. Genes in this dataset were ranked by the t-statistic of the Lm term in the linear model represented by equation (2) shown above. This list was analyzed for enrichment of gene sets composed of genes reported to be associated with COPD or emphysema in five other studies (Golpon, H. A. et al. American journal of respiratory cell and molecular biology 2004 31:595-600: Ning, W. et al. PNAS 2004 101:14895-900; Bhattacharya, S. et al. American journal of respiratory cell and molecular biology 2009 40:359-67; Spira, A. et al. American journal of respiratory cell and molecular biology 2004 31: 601-10; Wang, I.-M. et al. American journal of respiratory and critical care medicine 2008 177:402-11). Conversely, gene sets consisting of the genes we identified to be significantly associated with Lm (FDR <0.1) were used to explore other COPD-related datasets with data available from GEO: GSE11223, GSE85007, GSE85815, and GSE16506. For those datasets where raw data was available, the Entrez gene chip definition file (CDF) was used to obtain RMA normalized expression values. Genes from these datasets were ranked by t-statistic. For dichotomous variables, the t-statistic was calculated from a comparison of expression levels observed in the two groups (e.g. cases and controls). For continuous variables, the t-statistic was from a linear model of expression as a function of the continuous variable (e.g. FEV1). Datasets that measured the effect of TGFβ ligands on gene expression in various cell types included Chambers et al., (The American journal of pathology 2003162:533-46) Verrecchia et al., (The Journal of biological chemistry 2001 276:17058-62), GSE749712, GSE545010, GSE665314, GSE1171013, and GSE172415. Lists of genes that change with TGFβ exposure were taken from the publication associated with the microarray data. If lists of at least 25 genes could not be obtained from the literature, the raw data was used from GEO and normalized as described above. The 200 genes with the highest fold change and the 200 genes with the lowest fold change were used as gene sets and compared to a list of all genes from this dataset ranked by their correlation to Lm. Conversely, sets of genes significantly correlated to Lm were compared to lists of all genes ranked by fold change between cells treated and untreated with TGFβ.

Functional Enrichment Analysis

Functional enrichment analysis was performed using DAVID or gene set enrichment analysis (GSEA) (Dennis, G. et al. Genome biology 2003 4:P3; Subramanian, A. et al. PNAS 2005 102:15545-50). For DAVID, functional enrichment was examined among GO categories, and KEGG and BIOCARTA pathways using a modified Fisher exact test and FDR correction. For GSEA, genes were ranked by the t-statistic of the Lm term in the linear mixed-effects model and then analyzed for the enrichment of canonical pathways and GeneOntology (GO) term gene sets obtained from MSigDB (available at the world wide web address, broadinstitute.org/gsea/msigdb/index.jsp).

Real Time PCR Validation

Quantitative RT-PCR analysis was used to confirm the expression levels of select genes. ACVRL1, BCL11A, CCR7, CD79A, CXCL13, EPAS1, FOXF1, KLF13, S100A8, SMAD6, WFDC1, and TAL1 were associated with Lm (FDR <0.1) while GATA2 and TBX3 and were among the most highly connected genes in the relevance network. Primer sequences for the fourteen genes chosen for validation were designed with PRIMER EXPRESS software (Applied Biosystems, Foster City, Calif.). Primer sequences to measure the expression of housekeeping genes (GAPDH, TBP, YWHAZ) were adopted from Vandesompele et al., Genome Biology 2002 3:RESEARCH0034. The sequences used for all primers are provided in Supplementary Table 1. RNA samples (2 µg of RNA from the samples used in the microarray analysis) were treated with TURBO DNA-free (Ambion, Foster City, Calif.), according to the manufacturer's protocol, to remove contaminating genomic DNA. Total RNA was reverse-transcribed using random hexamers (Applied Biosystems) and SuperScript II reverse transcriptase (Invitrogen, Carlsbad, Calif.). The resulting first-strand cDNA was diluted with nuclease-free water (Ambion) to 4 ng/µl. PCR amplification mixtures (25 µl) contained 20 ng template cDNA, 12.5 µl of 2×SYBR Green PCR master mix (Applied Biosystems) and 300 nM forward and reverse primers. Forty cycles of amplification and data acquisition were carried out in StepOnePlus Real-Time PCR systems (Applied Biosystems).

Threshold determinations were automatically performed by StepOne Software (version 2.0.2; Applied Biosystems) for each reaction. All real-time PCR experiments were carried out in triplicate on each sample. Data analysis was performed using geNorm. Three genes (GAPDH, TBP, YWHAZ) were used for normalization.

Immunohistochemistry

Portions of a frozen tissue core close to the source of RNA were vacuum embedded in diluted Tissue-Tek O.C.T. compound (Sakura Finetek USA Inc, Torrance, Calif., USA) (50% vol/vol) in PBS containing 10% sucrose kept just above the freezing point and immediately refrozen on dry ice. Histology sections cut from these frozen blocks were air-dried at room temperature overnight and stained with appropriate antibodies (Table 3; RT=room temperature). Each antibody was optimized prior to performing a staining run on an automatic immunostainer (Dako, Mississauga, ON, Canada) using MACH 4 Universal AP Polymer Detection Kit (BioCare Medical, Concord, Calif., USA), and each section was counterstained with hematoxylin. Non-specific IgG substitution for specific antibodies provided negative controls. Digital images were captured using a Nikon E-800 microscope and the volume fraction of the tissue containing positively stained cells was determined using ImagePro Plus software (Media Cybernetics, Bethesda, Md., USA) (Hogg, J. C. et al. The New England journal of medicine 2004 350:2645-53).

TABLE 3

Antibodies Used for Immunohistochemistry

| Antibody | Company | Catalog No. | Host | Dilution | Fixation |
| --- | --- | --- | --- | --- | --- |
| CD79a | Dako | M7050 | Mouse | 1/50 | acetone, RT, 10 min |
| SMAD1 | Abnova | DP0239 | Rabbit | 1/400 | cold acetone, 5 min |
| SMAD2 | LifeSpan Biosciences | LS-C39128 | Rabbit | 1/100 | acetone, RT, 10 min |
| SMAD6 | LifeSpan Biosciences | LS-B2065 | Rabitt | 1/25 | 10% formalin, RT, 10 min |

Connectivity Map

The 50 most up and 50 most down-regulated genes that change with several conditions were used as separate query signatures for the Connectivity Map (Lamb, J. et al. Science 2006 313:1929-35). These include gene expression profiles changing as a function of regional emphysema severity, expression profiles changing with FEV1, FEV1/FVC, or between cases vs. controls in Bhattacharya et al., (American journal of respiratory cell and molecular biology 2009 40:359-67), expression profiles changing between controls vs. emphysema patients or by controls vs. α1-antitrypsin disease in Goplon et al., (American journal of respiratory cell and molecular biology 2004 31:595-600), expression profiles changing with FEV1, FEV1/FVC, DLCO, or between cases and controls in Spira et al., (American journal of respiratory cell and molecular biology 2004 31: 601-10) and expression profiles changing with FEV1, non-smokers vs. GOLD2, or non-smokers vs. GOLD3 in Wang et al (American journal of respiratory and critical care medicine 2008 177:402-11). In addition, gene expression profiles that change with TGFβ treatment from Qin et al., (BMC systems biology 2009 3:73), Classen et al., (Journal of immunology 2007 178:6931-40), Renzoni et al., (Respiratory research 2004 5:24), Koinuma et al., (Molecular and cellular biology 2009 29:172-86), and Malizia et al., (American journal of physiology. Lung cellular and molecular physiology 2008 295:L451-60) were used as separate query signatures. For each dataset, gene symbols were mapped to every corresponding probe set id on the Affymetrix U133A array in R using the hgu133a.db package to create the query signatures. For comparison of CMap data to in vitro studies, raw data for GHK was downloaded from the CMap website and normalized using MAS5.0 Gene expression profiles were ranked by a paired t-test between treatment and controls of different batches.

Fibroblast Cultures

Normal human diploid lung fibroblasts (HFL-1) were obtained from the American Type Culture Collection (Manassas, Va.) and used between 3-5 consequent passages after thawing of frozen cells. HFL-1 cells were placed in 6-well culture plates (BD Biosciences, Mississauga, ON) at a density of $1 \times 10^5$ cells per well in complete cell culture medium (CCM, DMEM supplemented with 10% FBS, 2 mM L-glutamine and 1% of antibiotic solution; Invitrogen, Burlington, ON). Cells were cultured at 37° C. and 5% CO2 in CCM before they reached 80% confluence. Cells were quiesced in CCM with 1% FBS overnight. HFL-1 cultures were treated with Gly-His-Lys acetate (GHK, Sigma-Aldrich, Oakville, ON) at concentrations of 100 µM and 10 nM, recombinant human TGFβ1 (10 ng/ml, PeproTech, Rocky Hill, N.J.) alone or in combination with GHK for 48 hrs. Cells exposed to the CCM with added DMSO served as a vehicle control. Experiments were repeated 3 times using HFL-1 cells during 3 consequent cell culture passages. Total RNA was isolated from HFL-1 monolayers using RNeasy Plus Mini-Kit (Qiagen, Valencia, Calif.) as per manufacturer's instructions. Quantity and quality of the isolated RNA was determined using Agilent 2100 Bioanalyzer (Agilent Technologies, Mississauga, ON). Isolated RNA was processed and hybridized onto the Human Gene 1.0 ST array (Affymetrix Inc., Santa Clara, Calif.) according to the manufacturer's protocol. Transcript-level gene expression estimates were generated using RMA with the Entrez gene CDF version v11. Differentially expressed gene expression profiles were identified using a one-way ANOVA for GHK treatment and a t-test for TGFβ1 treatment. Gene expression profiles were ranked for each treatment by t-statistic. The 200 most up-regulated and the 200 most down-regulated gene profiles were used as gene sets for each treatment in GSEA.

Immunoblotting for β1-Integrin

Production of β1-integrin by HFL-1 cells was assessed by immunoblotting as previously described (Pechkovsky, D. V. et al. The Journal of biological chemistry 2008 283:12898-908). Briefly, total cell protein was extracted from cultured HFL-1 using Cell Protein Extraction Buffer (Biosource, Camarillo, Calif.), quantified by DC Protein Assay (Bio-Rad, Hercules, Calif.), resolved by SDS-PAGE, and transferred to nitrocellulose membranes. Membranes were probed with mouse anti-human β1-integrin antibody (clone 419127, R&D Systems, Minneapolis, Minn.) and anti-β-tubulin antibody (Millipore, Billerica, Mass.) as a loading control. Detection was performed using the IR800 detection goat-anti-mouse antibody (Rockland Immunochemicals, Gilbertsville, Pa.) and Odyssey Infrared Imaging System (LI-COR Biosciences, Lincoln, Nebr.) as recommended by manufacturer. Density of the bands was quantified using Odyssey software 2.1 (LI-COR Biosciences). The data are presented as β1 integrin/β-tubulin density ratios.

Statistical Analysis

All statistical analyses were conducted using R statistical software v 2.9 and Bioconductor packages v2.4.

Example 2

Expression Profiling of Emphysematous Lung Tissue

Study Population

In order to gain insights into biological processes associated with increasing emphysema severity and to discover novel compounds for the treatment of emphysema, paired samples were obtained at 8 regions from within regular intervals between the apex and base of explanted lungs from patients with GOLD-4 COPD (n=6) and donors (n=2). The degree of emphysematous destruction was quantified in one sample from each region by mean linear intercept (Lm), a morphological measurement of alveolar destruction derived from micro-CT scans of the frozen lung tissue specimen, while gene expression was profiled in the corresponding sample from the same region.

Lm was quantified using micro-CT scans in eight samples from different regions of lungs from six subjects that required transplantation for COPD and two organ donors (FIG. 1). Table 4 shows the demographic information and clinical characteristics of the eight subjects used in this study. As expected, samples from subjects with COPD had a higher mean and a greater range of Lm values between samples compared to those from donor lungs, indicating that there are regions of severe emphysema in COPD subjects (Table 4). Subject 6967 was diagnosed with a Pure Airway Obstruction (PAO) COPD phenotype without emphysema. Reflecting this diagnosis, the distribution of Lm measurements for this patient closely resembles the distribution of Lm measurements from the donor lungs. Subject 6970 was diagnosed with α-1 antitrypsin (AAT) deficiency. The remaining four subjects with COPD had the centrilobular emphysematous phenotype commonly observed in smokers. Subject 6969 had one sample excluded from subsequent analysis because its Lm measurement was an outlier (more than 3 times the interquartile range of the distribution of all Lm measurements of all of the lungs examined). Subjects with COPD had FEV1/FVC <70% and FEV1 <25% predicted. Some COPD patients had other diseases including von Willebrand disease*, hypertension†, and α-1 Antitrypsin deficiency disease‡.

TABLE 4

Subject demographics

| Patient ID | Description | Sex | Age | Pack Years | Smoking Status | Lm Mean +/− SD (μm) | Lm Range (μm) |
|---|---|---|---|---|---|---|---|
| 6965 | COPD | M | 62 | 50 | Former | 716 +/− 164 | 494-982 |
| 6967 | COPD | F | 61 | 25 | Former | 414 +/− 82 | 334-585 |
| 6968 | COPD | F | 63 | 38 | Former | 724 +/− 252 | 357-1013 |
| 6969 | COPD*† | F | 56 | 54 | Former | 1822 +/− 1270 | 521-4620 |
| 6970 | COPD‡ | M | 55 | 15 | Former | 1352 +/− 599 | 647-2551 |
| 6971 | COPD | M | 59 | 30 | Former | 1097 +/− 441 | 720-2101 |
| 6982 | Donor | M | 59 | — | Never | 384 +/− 47 | 344-473 |
| 6983 | Donor | M | 62 | 24 | Former | 289 +/− 41 | 231-352 | von Willebrand disease*;
hypertension†;
α-1 Antitrypsin deficiency disease‡

Gene Expression Profiles Associated with Regional Emphysema Severity

By ANOVA, the expression levels of one-hundred twenty-seven genes were significantly associated with Lm and thus associated with regional emphysema severity (Tables 1, 2 and 5; FDR <0.10 corresponding to a p-value <0.0007). Table 5 shows data concerning the extent of differential gene expression. The third column of Table 5 shows the controlled log 2 fold change in gene expression per unit increase in Lm. The fourth column of Table 5 shows the log 2 fold change in gene expression between the healthiest third of the samples used, as measured by Lm, and the third of the samples most affected by emphysema, as measured by Lm.

The expression of 49 genes increased as a function of increasing regional emphysema severity. Genes with functions in the B cell receptor signaling pathway and the humoral immune response were overrepresented among these up-regulated genes (FDR <0.05). In contrast, 78 genes showed decreased expression as a function of increasing regional emphysema severity, and genes involved in cellular structure, integrin signaling, extracellular matrix, focal adhesion, blood vessel morphogenesis, the VEGF pathway, and the TGFβ pathway were over-represented in this list (FDR <0.05; Table 6). The expression of CD79A, a component of the B cell receptor, increased with increasing emphysema severity (data not shown), and the expression of ACVRL1 (also known as activin-like kinase I), a receptor in the TGFβ pathway, decreased with increasing emphysema severity (data not shown). These genes are shown as examples of the characteristic relationship between Lm and gene expression observed in the data provided in Tables 1 and 2. A gene expression relevance network was inferred using the Context Likelihood of Related (CLR) algorithm (Faith, J. J. et al. PLoS biology 2007 5:e8) specifically to predict transcription factors that may play a role in emphysema pathogenesis. Transcription factors with the most edges included EPAS1 (also known as HIF-2a), KLF13, TAL1, TBX3, GATA2, and BCL11A (FIGS. 2A-2C).

TABLE 5

Genes with differential expression in healthy lung tissue and lung tissue with emphysematous damage

| Affy_ID | Gene | Log2 Fold Change/Unit Increase in Lm | Log2 Fold Change (1st vs. 3rd Tertile) | T-stat for Column 3 | P-value of Colum 5 | FDR |
|---|---|---|---|---|---|---|
| 554975 | BCL11A | 0.29 | 0.37 | 7.62 | 3.02E−07 | 0.002696819 |
| 3256590 | PAPSS2 | −0.50 | −0.65 | −8.15 | 2.14E−07 | 0.002696819 |
| 3756319 | CCR7 | 0.46 | 0.60 | 6.66 | 6.12E−07 | 0.00364382 |
| 3671695 | WFDC1 | −0.41 | −0.53 | −5.98 | 1.41E−06 | 0.006309394 |
| 3555088 | KIAA0125 | 0.61 | 0.79 | 5.42 | 2.31E−06 | 0.008255258 |
| 2514216 | NOSTRIN | −0.77 | −0.99 | −8.12 | 6.22E−06 | 0.018533994 |
| 3709685 | NDEL1 | −0.25 | −0.32 | −5.83 | 9.64E−06 | 0.024601661 |
| 3830359 | CD22 | 0.34 | 0.44 | 4.63 | 1.25E−05 | 0.024783955 |
| 3442579 | RBP5 | 0.35 | 0.45 | 5.81 | 1.17E−05 | 0.024783955 |
| 2452977 | FAIM3 | 0.42 | 0.54 | 5.16 | 1.68E−05 | 0.025203051 |
| 3508898 | STARD13 | −0.30 | −0.39 | −5.64 | 1.83E−05 | 0.025203051 |
| 2941784 | NEDD9 | −0.49 | −0.63 | −5.90 | 1.83E−05 | 0.025203051 |
| 2514304 | DHRS9 | 0.74 | 0.95 | 5.00 | 1.73E−05 | 0.025203051 |
| 3333443 | ASRGL1 | −0.40 | −0.52 | −5.58 | 2.57E−05 | 0.032786798 |
| 3518766 | EDNRB | −0.57 | −0.74 | −4.56 | 2.86E−05 | 0.034134938 |
| 3587015 | KLF13 | −0.24 | −0.31 | −5.15 | 3.37E−05 | 0.037650711 |
| 2363852 | FCRLA | 0.29 | 0.38 | 4.82 | 4.11E−05 | 0.03862529 |
| 3223928 | STOM | −0.22 | −0.28 | −5.24 | 3.91E−05 | 0.03862529 |
| 3671727 | ATP2C2 | 0.31 | 0.40 | 5.37 | 4.05E−05 | 0.03862529 |
| 3865503 | GPR4 | −0.41 | −0.52 | −4.41 | 4.81E−05 | 0.042988418 |
| 3209384 | TMEM2 | −0.41 | −0.53 | −4.61 | 6.24E−05 | 0.048500471 |
| 2610972 | SYN2 | −0.31 | −0.40 | −4.30 | 6.07E−05 | 0.048500471 |
| 3662158 | MT1JP | −1.33 | −1.71 | −5.39 | 5.71E−05 | 0.048500471 |
| 2553576 | RTN4 | −0.23 | −0.29 | −4.39 | 9.35E−05 | 0.055840204 |
| 3142217 | PAG1 | −0.41 | −0.52 | −6.26 | 9.16E−05 | 0.055840204 |
| 3501219 | COL4A2 | −0.31 | −0.40 | −4.14 | 8.98E−05 | 0.055840204 |
| 3665029 | CES3 | 0.19 | 0.25 | 5.11 | 9.02E−05 | 0.055840204 |
| 2640993 | KLHDC6 | 0.25 | 0.32 | 5.13 | 8.86E−05 | 0.055840204 |
| 2403080 | FCN3 | −0.62 | −0.80 | −4.40 | 9.69E−05 | 0.055840204 |
| 3368940 | ABTB2 | −0.15 | −0.20 | −5.66 | 9.51E−05 | 0.055840204 |
| 2327219 | STX12 | −0.34 | −0.44 | −4.50 | 8.97E−05 | 0.055840204 |
| 3415109 | ACVRL1 | −0.51 | −0.65 | −4.89 | 1.12E−04 | 0.062276427 |
| 2955932 | GPR110 | 0.74 | 0.96 | 4.28 | 1.29E−04 | 0.0634364 |
| 3102204 | C8orf34 | 0.38 | 0.49 | 4.73 | 1.18E−04 | 0.0634364 |
| 2438411 | NES | −0.30 | −0.39 | −4.42 | 1.24E−04 | 0.0634364 |
| 2453365 | PLXNA2 | −0.35 | −0.45 | −4.17 | 1.31E−04 | 0.0634364 |
| 2377283 | CR2 | 0.44 | 0.57 | 4.51 | 1.31E−04 | 0.0634364 |
| 3073013 | PODXL | −0.47 | −0.60 | −4.76 | 1.39E−04 | 0.065583746 |
| 3766796 | PECAM1 | −0.36 | −0.46 | −4.59 | 1.49E−04 | 0.066237807 |
| 3094778 | TACC1 | −0.27 | −0.34 | −5.61 | 1.59E−04 | 0.066237807 |
| 3486956 | C13orf15 | −0.43 | −0.56 | −4.11 | 1.56E−04 | 0.066237807 |
| 2435989 | S100A8 | −0.96 | −1.24 | −4.01 | 1.58E−04 | 0.066237807 |
| 2876543 | C5orf20 | 0.22 | 0.28 | 5.11 | 1.57E−04 | 0.066237807 |
| 2509988 | LOC130576 | 0.21 | 0.27 | 4.01 | 1.65E−04 | 0.067004025 |
| 3590129 | ZFYVE19 | 0.12 | 0.16 | 4.09 | 1.69E−04 | 0.067228391 |
| 3226097 | ENG | −0.33 | −0.43 | −4.46 | 1.75E−04 | 0.067825806 |
| 3955915 | TPST2 | −0.17 | −0.22 | −4.00 | 1.80E−04 | 0.068624866 |
| 3629652 | NOPE | 0.16 | 0.21 | 4.16 | 1.91E−04 | 0.069991223 |
| 3415320 | KRT7 | −0.55 | −0.71 | −3.93 | 1.92E−04 | 0.069991223 |
| 2894790 | SYCP2L | −0.43 | −0.56 | −4.20 | 1.97E−04 | 0.070408299 |
| 3959451 | MYH9 | −0.19 | −0.25 | −4.98 | 2.07E−04 | 0.072676061 |
| 3954910 | DERL3 | 0.30 | 0.39 | 3.91 | 2.25E−04 | 0.072972083 |
| 2844888 | BTNL3 | −0.31 | −0.40 | −4.65 | 2.29E−04 | 0.072972083 |
| 2352169 | WNT2B | −0.32 | −0.41 | −4.89 | 2.22E−04 | 0.072972083 |
| 3351564 | PHLDB1 | −0.31 | −0.40 | −3.96 | 2.21E−04 | 0.072972083 |
| 2335014 | CYP4Z1 | −0.35 | −0.45 | −4.44 | 2.14E−04 | 0.072972083 |
| 3041875 | OSBPL3 | 0.19 | 0.24 | 3.82 | 2.37E−04 | 0.073973746 |
| 2877893 | MGC29506 | 0.48 | 0.61 | 3.82 | 2.40E−04 | 0.073973746 |
| 3387708 | UNQ6228 | 0.28 | 0.36 | 5.65 | 2.52E−04 | 0.07508813 |
| 3598758 | SMAD6 | −0.67 | −0.86 | −4.45 | 2.49E−04 | 0.07508813 |
| 2326049 | MAN1C1 | 0.15 | 0.19 | 3.76 | 2.71E−04 | 0.075704993 |
| 2480168 | PRKCE | −0.38 | −0.49 | −4.41 | 2.92E−04 | 0.075704993 |
| 3553228 | RCOR1 | −0.22 | −0.28 | −3.95 | 2.69E−04 | 0.075704993 |
| 3159754 | DMRT2 | 0.14 | 0.18 | 4.61 | 2.88E−04 | 0.075704993 |
| 2732508 | CXCL13 | 0.90 | 1.17 | 4.02 | 2.65E−04 | 0.075704993 |
| 2740507 | UGT8 | 0.18 | 0.24 | 3.75 | 2.77E−04 | 0.075704993 |
| 3869097 | SIGLEC6 | 0.30 | 0.38 | 4.16 | 2.63E−04 | 0.075704993 |
| 2401193 | LUZP1 | −0.22 | −0.29 | −4.52 | 2.90E−04 | 0.075704993 |
| 3834502 | CD79A | 0.60 | 0.78 | 3.90 | 2.81E−04 | 0.075704993 |
| 2735459 | HERC3 | −0.22 | −0.29 | −4.42 | 3.56E−04 | 0.079319593 |
| 3161167 | KIAA1432 | −0.20 | −0.26 | −3.71 | 3.83E−04 | 0.079319593 |
| 3234760 | CUGBP2 | −0.20 | −0.26 | −4.76 | 3.89E−04 | 0.079319593 |
| 3414885 | SLC4A8 | 0.37 | 0.47 | 3.93 | 4.11E−04 | 0.079319593 |

TABLE 5-continued

Genes with differential expression in healthy lung tissue and lung tissue with emphysematous damage

| Affy_ID | Gene | Log2 Fold Change/Unit Increase in Lm | Log2 Fold Change (1st vs. 3rd Tertile) | T-stat for Column 3 | P-value of Colum 5 | FDR |
|---|---|---|---|---|---|---|
| 3824427 | FAM129C | 0.17 | 0.22 | 4.54 | 4.43E-04 | 0.079319593 |
| 2497301 | TMEM182 | 0.17 | 0.22 | 4.19 | 4.64E-04 | 0.079319593 |
| 2955999 | GPR110 | 0.69 | 0.88 | 4.21 | 3.26E-04 | 0.079319593 |
| 2759038 | CRMP1 | -0.20 | -0.25 | -3.61 | 4.29E-04 | 0.079319593 |
| 2349129 | S1PR1 | -0.48 | -0.62 | -4.61 | 4.53E-04 | 0.079319593 |
| 3372896 | FOLH1 | 0.17 | 0.21 | 3.82 | 4.47E-04 | 0.079319593 |
| 3667508 | CALB2 | 0.21 | 0.28 | 4.84 | 4.14E-04 | 0.079319593 |
| 3404636 | GABARAPL1 | -0.32 | -0.41 | -3.72 | 3.61E-04 | 0.079319593 |
| 2708066 | KLHL6 | 0.41 | 0.53 | 3.85 | 4.53E-04 | 0.079319593 |
| 7385611 | HPCAL1 | -0.23 | -0.30 | -4.58 | 3.44E-04 | 0.079319593 |
| 3633578 | CSPG4 | -0.31 | -0.41 | -4.68 | 4.05E-04 | 0.079319593 |
| 3223157 | DBC1 | -0.65 | -0.83 | -4.23 | 3.97E-04 | 0.079319593 |
| 4001223 | RAI2 | -0.26 | -0.34 | -3.82 | 4.33E-04 | 0.079319593 |
| 3747236 | C17orf76 | 0.21 | 0.27 | 3.94 | 3.47E-04 | 0.079319593 |
| 3484895 | KL | -0.37 | -0.48 | -3.82 | 3.81E-04 | 0.079319593 |
| 3558418 | STXBP6 | -0.41 | -0.53 | -3.95 | 4.13E-04 | 0.079319593 |
| 3525313 | COL4A1 | -0.33 | -0.43 | -3.73 | 3.56E-04 | 0.079319593 |
| 2411198 | TAL1 | -0.27 | -0.35 | -4.07 | 4.28E-04 | 0.079319593 |
| 2935475 | QKI | -0.27 | -0.35 | -4.18 | 3.46E-04 | 0.079319593 |
| 3082874 | ARHGEF10 | -0.34 | -0.44 | -4.18 | 3.16E-04 | 0.079319593 |
| 2615892 | CMTM8 | -0.31 | -0.39 | -4.24 | 4.67E-04 | 0.079319593 |
| 3672609 | FOXF1 | -0.24 | -0.31 | -3.93 | 3.94E-04 | 0.079319593 |
| 2599371 | TMBIM1 | -0.18 | -0.23 | -4.14 | 3.96E-04 | 0.079319593 |
| 2525533 | MAP2 | -0.43 | -0.55 | -3.66 | 4.67E-04 | 0.079319593 |
| 2369339 | RALGPS2 | 0.42 | 0.54 | 4.31 | 4.24E-04 | 0.079319593 |
| 2664209 | SH3BP5 | -0.32 | -0.41 | -4.41 | 4.07E-04 | 0.079319593 |
| 2491788 | ATOH8 | -0.36 | -0.46 | -6.31 | 4.16E-04 | 0.079319593 |
| 2450668 | TMEM9 | 0.17 | 0.22 | 4.59 | 4.08E-04 | 0.079319593 |
| 2458649 | C1orf55 | -0.22 | -0.29 | -3.89 | 4.70E-04 | 0.079319593 |
| 2925590 | TMEM200A | 0.25 | 0.33 | 3.73 | 3.22E-04 | 0.079319593 |
| 2352106 | CTTNBP2NL | -0.28 | -0.36 | -4.34 | 3.81E-04 | 0.079319593 |
| 2343823 | LPHN2 | -0.48 | -0.62 | -3.77 | 4.66E-04 | 0.079319593 |
| 3087703 | PDGFRL | 0.31 | 0.40 | 3.92 | 4.61E-04 | 0.079319593 |
| 3467351 | ANKS1B | 0.20 | 0.26 | 3.59 | 4.77E-04 | 0.079687054 |
| 2619265 | VIPR1 | -0.65 | -0.84 | -3.87 | 4.91E-04 | 0.080631196 |
| 3822723 | PKN1 | -0.29 | -0.37 | -4.72 | 4.96E-04 | 0.080631196 |
| 3933243 | PRDM15 | 0.11 | 0.14 | 4.65 | 4.94E-04 | 0.080631196 |
| 3235255 | ECHDC3 | -0.27 | -0.35 | -4.21 | 5.12E-04 | 0.082469476 |
| 3265140 | ADRB1 | -0.46 | -0.59 | -4.33 | 5.28E-04 | 0.084211404 |
| 3438061 | GPR133 | -0.28 | -0.35 | -4.01 | 5.47E-04 | 0.084405378 |
| 3780981 | KIAA1772 | -0.12 | -0.16 | -3.83 | 5.34E-04 | 0.084405378 |
| 3009959 | PTPN12 | -0.26 | -0.34 | -4.05 | 5.48E-04 | 0.084405378 |
| 3818842 | ZNF358 | -0.19 | -0.25 | -4.38 | 5.47E-04 | 0.084405378 |
| 2366798 | PRRX1 | 0.32 | 0.41 | 3.60 | 5.64E-04 | 0.086141985 |
| 2452615 | SLC45A3 | 0.31 | 0.40 | 4.30 | 5.69E-04 | 0.086197425 |
| 2891341 | IRF4 | 0.38 | 0.48 | 3.79 | 6.00E-04 | 0.090057239 |
| 3865998 | PNMAL1 | 0.26 | 0.33 | 3.73 | 6.22E-04 | 0.092619207 |
| 3190778 | LRRC8A | -0.37 | -0.48 | -4.33 | 6.42E-04 | 0.094879887 |
| 3975227 | MAOA | -0.44 | -0.57 | -3.98 | 6.54E-04 | 0.095846279 |
| 3766533 | CD79B | 0.16 | 0.21 | 4.17 | 6.84E-04 | 0.097822364 |
| 2480383 | EPAS1 | -0.32 | -0.41 | -3.69 | 6.81E-04 | 0.097822364 |
| 2615360 | TGFBR2 | -0.15 | -0.20 | -4.01 | 6.77E-04 | 0.097822364 |
| 3782069 | transcript 3782069, GenBank BC012036 | 0.20 | 0.25 | 4.51 | 6.90E-04 | 0.097922646 |
| 2429235 | AMPD1 | 0.45 | 0.58 | 3.47 | 6.97E-04 | 0.098051775 |

TABLE 6

Functional categories enriched among genes associated with regional emphysema severity

| Category | Direction of Enrichment | Enrichment Tool |
|---|---|---|
| h_bcrmolecule: B Cell Receptor Complex | Up-regulated | DAVID |
| hsa04662: B cell receptor signaling pathway | Up-regulated | DAVID |
| Immunoglobulin domain | Up-regulated | DAVID |
| IPR013151: Immunoglobulin | Up-regulated | DAVID |
| IPR013783: Immunoglobulin-like fold | Up-regulated | DAVID |

TABLE 6-continued

Functional categories enriched among genes associated with regional emphysema severity

| Category | Direction of Enrichment | Enrichment Tool |
| --- | --- | --- |
| signal | Up-regulated | DAVID |
| SM00409: IG | Up-regulated | DAVID |
| HUMORAL_IMMUNE_RESPONSE | Up-regulated | GSEA |
| GO:0001525~angiogenesis | Down-regulated | DAVID |
| GO:0001568~blood vessel development | Down-regulated | DAVID |
| GO:0001944~vasculature development | Down-regulated | DAVID |
| GO:0019838~growth factor binding | Down-regulated | DAVID |
| GO:0034713~type I transforming growth factor beta receptor binding | Down-regulated | DAVID |
| GO:0048514~blood vessel morphogenesis | Down-regulated | DAVID |
| h_akapCentrosomePathway: Protein Kinase A at the Centrosome | Down-regulated | DAVID |
| phosphoprotein | Down-regulated | DAVID |
| HSA04510_FOCAL_ADHESION | Down-regulated | GSEA |
| CXCR4PATHWAY | Down-regulated | GSEA |
| ST_INTEGRIN_SIGNALING_PATHWAY | Down-regulated | GSEA |
| ECMPATHWAY | Down-regulated | GSEA |
| HSA04810_REGULATION_OF_ACTIN_CYTOSKELETON | Down-regulated | GSEA |
| HSA04320_DORSO_VENTRAL_AXIS_FORMATION | Down-regulated | GSEA |
| EIF4PATHWAY | Down-regulated | GSEA |
| GHPATHWAY | Down-regulated | GSEA |
| REGULATION_OF_CELL_MORPHOGENESIS | Down-regulated | GSEA |
| CYTOSKELETAL_PROTEIN_BINDING | Down-regulated | GSEA |
| VIPPATHWAY | Down-regulated | GSEA |
| HSA04520_ADHERENS_JUNCTION | Down-regulated | GSEA |
| SIG_INSULIN_RECEPTOR_PATHWAY_IN_CARDIAC_MYOCYTES | Down-regulated | GSEA |
| HSA04910_INSULIN_SIGNALING_PATHWAY | Down-regulated | GSEA |
| INTEGRIN_MEDIATED_CELL_ADHESION_KEGG | Down-regulated | GSEA |
| INSULIN_RECEPTOR_SIGNALING_PATHWAY | Down-regulated | GSEA |
| INTEGRINPATHWAY | Down-regulated | GSEA |
| HSA05214_GLIOMA | Down-regulated | GSEA |
| GTPASE_ACTIVITY | Down-regulated | GSEA |
| CELL_MIGRATION | Down-regulated | GSEA |
| HSA05220_CHRONIC_MYELOID_LEUKEMIA | Down-regulated | GSEA |
| RUFFLE | Down-regulated | GSEA |
| LEADING_EDGE | Down-regulated | GSEA |
| HSA05219_BLADDER_CANCER | Down-regulated | GSEA |
| VEGFPATHWAY | Down-regulated | GSEA |
| RASPATHWAY | Down-regulated | GSEA |
| HSA05212_PANCREATIC_CANCER | Down-regulated | GSEA |
| HSA04670_LEUKOCYTE_TRANSENDOTHELIAL_MIGRATION | Down-regulated | GSEA |
| SPPAPATHWAY | Down-regulated | GSEA |
| HSA05131_PATHOGENIC_ESCHERICHIA_COLI_INFECTION_EPEC | Down-regulated | GSEA |
| TUBULIN_BINDING | Down-regulated | GSEA |
| HSA05130_PATHOGENIC_ESCHERICHIA_COLI_INFECTION_EHEC | Down-regulated | GSEA |
| HSA05211_RENAL_CELL_CARCINOMA | Down-regulated | GSEA |
| LIPID_TRANSPORT | Down-regulated | GSEA |
| HSA03050_PROTEASOME | Down-regulated | GSEA |
| HSA05215_PROSTATE_CANCER | Down-regulated | GSEA |
| MITOCHONDRIAL_MEMBRANE_PART | Down-regulated | GSEA |
| MTORPATHWAY | Down-regulated | GSEA |
| SIG_PIP3_SIGNALING_IN_CARDIAC_MYOCTES | Down-regulated | GSEA |
| TRANSMEMBRANE_RECEPTOR_PROTEIN_TYROSINE_KINASE_SIGNALING_PATHWAY | Down-regulated | GSEA |
| REGULATION_OF_CELL_GROWTH | Down-regulated | GSEA |
| MCALPAINPATHWAY | Down-regulated | GSEA |
| ERK5PATHWAY | Down-regulated | GSEA |
| ERKPATHWAY | Down-regulated | GSEA |
| GTPASE_REGULATOR_ACTIVITY | Down-regulated | GSEA |
| PTENPATHWAY | Down-regulated | GSEA |
| PPARAPATHWAY | Down-regulated | GSEA |
| IGF1RPATHWAY | Down-regulated | GSEA |
| CCR3PATHWAY | Down-regulated | GSEA |
| ACTIN_BINDING | Down-regulated | GSEA |
| PDGFPATHWAY | Down-regulated | GSEA |
| PAR1PATHWAY | Down-regulated | GSEA |
| PROTEIN_AMINO_ACID_PHOSPHORYLATION | Down-regulated | GSEA |
| REGULATION_OF_CELL_MIGRATION | Down-regulated | GSEA |
| UBIQUITIN_MEDIATED_PROTEOLYSIS | Down-regulated | GSEA |
| AT1RPATHWAY | Down-regulated | GSEA |
| ACETYLTRANSFERASE_ACTIVITY | Down-regulated | GSEA |
| IGF1MTORPATHWAY | Down-regulated | GSEA |
| RHYTHMIC_PROCESS | Down-regulated | GSEA |
| PHOSPHORYLATION | Down-regulated | GSEA |
| SPLICEOSOME | Down-regulated | GSEA |

TABLE 6-continued

Functional categories enriched among genes associated with regional emphysema severity

| Category | Direction of Enrichment | Enrichment Tool |
|---|---|---|
| HSA04360_AXON_GUIDANCE | Down-regulated | GSEA |
| ST_ERK1_ERK2_MAPK_PATHWAY | Down-regulated | GSEA |
| CORTICAL_CYTOSKELETON | Down-regulated | GSEA |
| PROTEASOMEPATHWAY | Down-regulated | GSEA |
| EGFPATHWAY | Down-regulated | GSEA |
| HSA04720_LONG_TERM_POTENTIATION | Down-regulated | GSEA |
| PGC1APATHWAY | Down-regulated | GSEA |
| CIRCADIAN_EXERCISE | Down-regulated | GSEA |
| NFATPATHWAY | Down-regulated | GSEA |
| PTDINSPATHWAY | Down-regulated | GSEA |
| HSA04920_ADIPOCYTOKINE_SIGNALING_PATHWAY | Down-regulated | GSEA |
| ENZYME_LINKED_RECEPTOR_PROTEIN_SIGNALING_PATHWAY | Down-regulated | GSEA |
| POST_TRANSLATIONAL_PROTEIN_MODIFICATION | Down-regulated | GSEA |
| KERATINOCYTEPATHWAY | Down-regulated | GSEA |
| G_PROTEIN_SIGNALING | Down-regulated | GSEA |
| IL2RBPATHWAY | Down-regulated | GSEA |
| PROTEIN_SERINE_THREONINE_KINASE_ACTIVITY | Down-regulated | GSEA |
| HISTONE_ACETYLTRANSFERASE_ACTIVITY | Down-regulated | GSEA |
| REGULATION_OF_ANATOMICAL_STRUCTURE_MORPHOGENESIS | Down-regulated | GSEA |
| TRANSFORMING_GROWTH_FACTOR_BETA_RECEPTOR_SIGNALING_PATHWAY | Down-regulated | GSEA |

Figures 3A, 3B, 3C, 3D, 3E:
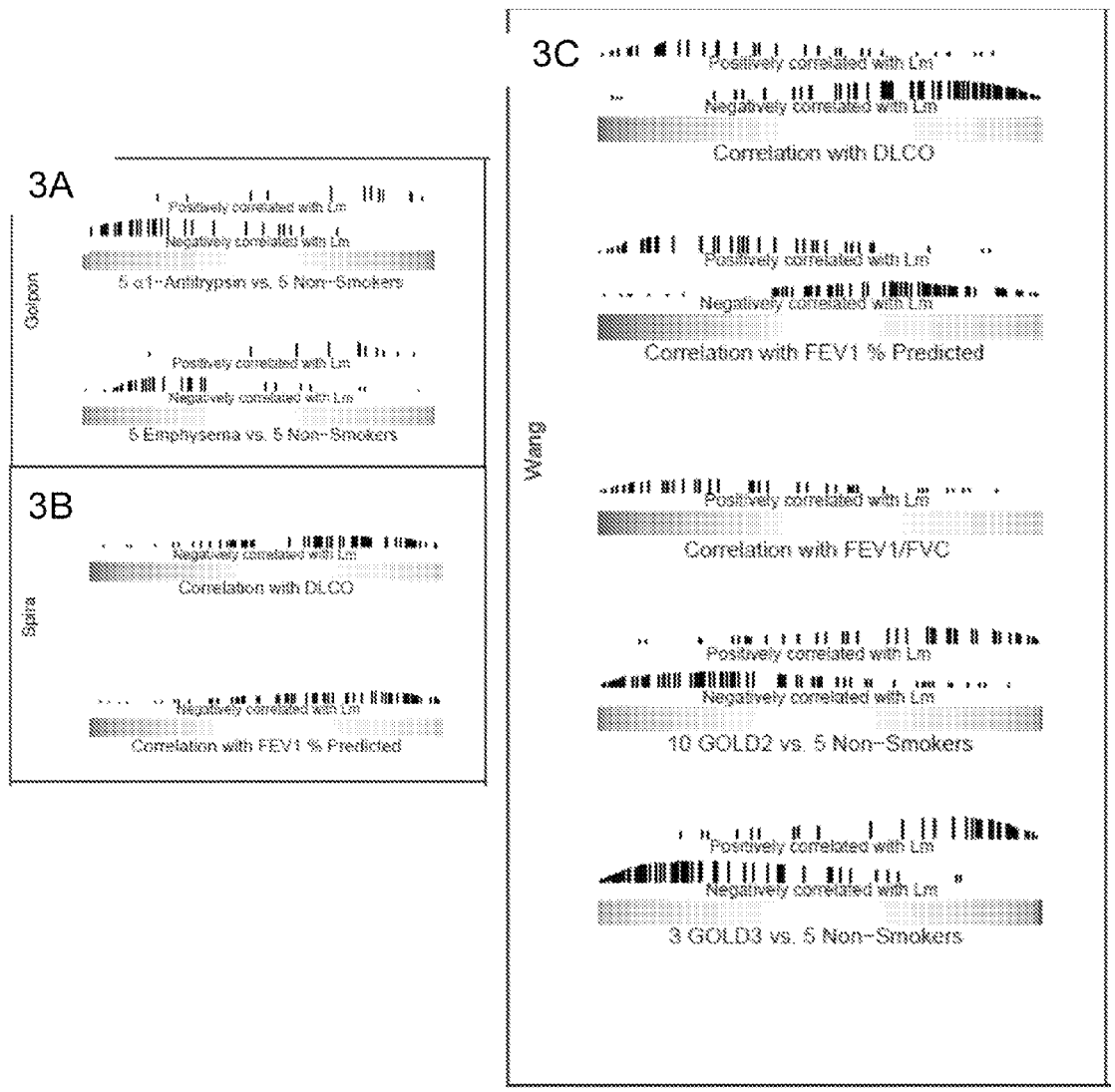
FIGS. 3A-3E shows the relationship between gene expression changes associated with regional emphysema severity (Lm) and cross-sectional studies of COPD-related gene expression using Gene Set Enrichment Analysis (GSEA). Black vertical lines represent the position of genes along the ranked gene list. The lengths of the black lines correspond to the magnitude of the running enrichment score from GSEA. Enrichments with an FDR q-value <0.05 were considered significant.
Figures 3A, 3B, 3C, 3D, 3E:
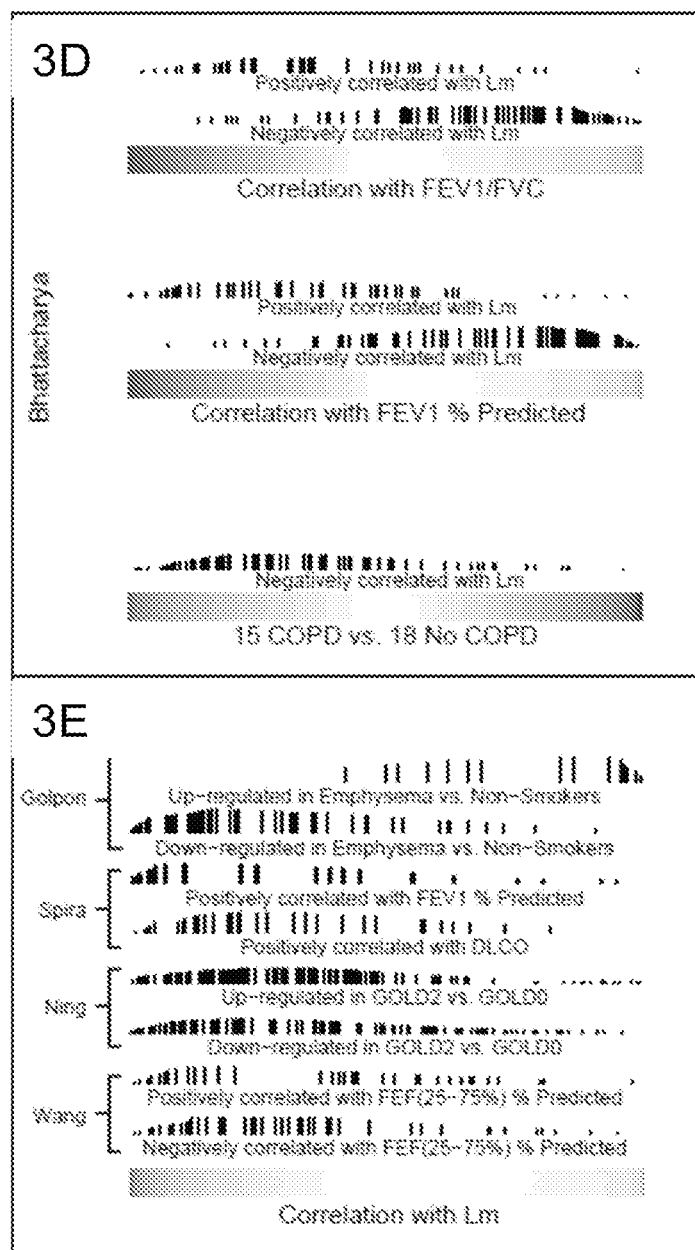
Figure 4:
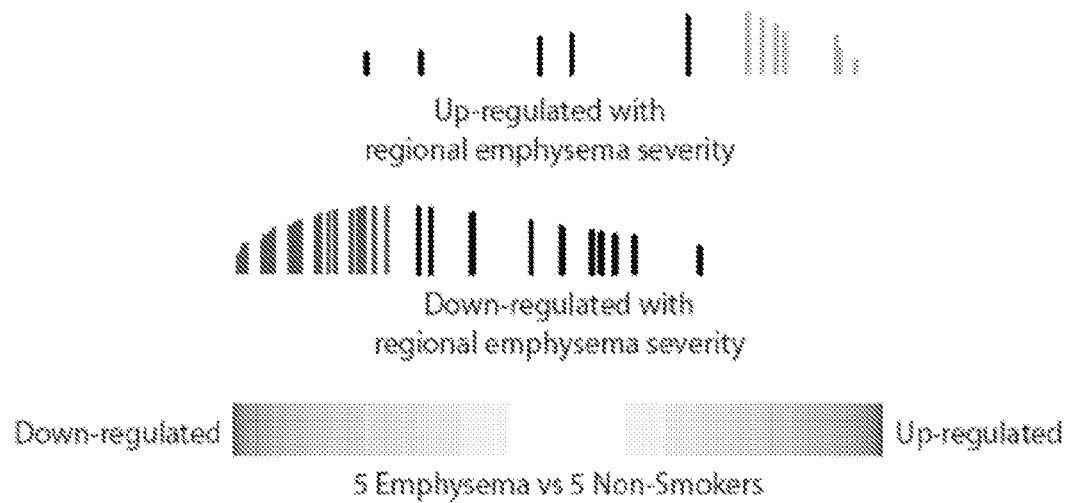
FIG. 4 shows correlations demonstrating the relationship between gene expression changes associated with Lm and the cross-sectional stuffy of COPD-related gene expression from Goplon et al., (American journal of respiratory cell and molecular biology 2004 31:595-600). The gradated bar represents the t-statistic from a t-test between five emphysema patients and five non-smokers for 5,209 genes. The right end of the bar indicates a more positive t-statistic and left indicates a more negative t-statistic (induced or repressed in COPD, respectively). The vertical lines represent the position of genes associated with regional emphysema severity in the t-statistic ranking. The height of the vertical lines corresponds to the magnitude of the running enrichment score from GSEA.

Relationship Between Gene Expression Profiles Associated with Regional Emphysema Severity and COPD-Related Expression Profiles Identified in Other Studies GSEA was used to examine the relationship between gene expression profiles associated with regional emphysema severity as measured by Lm and previously published cross-sectional studies of gene expression in COPD and COPD-related phenotypes. The genes that decreased in expression with increasing emphysema severity were enriched amongst genes down-regulated in COPD phenotypes from four freely available datasets (FIGS. 3A-3D). In addition, genes that increased in expression with increasing emphysema severity were enriched amongst genes up-regulated in COPD phenotypes in three of the same datasets (FIGS. 3A, 3C, and 3D). As an example, the enrichment of genes associated with emphysema severity in the data from Golpon et al (American journal of respiratory cell and molecular biology 2004 31:595-600) can be seen in FIG. 4 (the genes include AMPD1, CD79A, PDGFRL, CD79B, CCR7, UGT8, CD22, PRXCE, MAOA, MAPS2, ACVRL1, STOM, GPR4, S100A8, RCOR1, CUGBP2, TGFBR2, KRT7, TAL1, S1PR1, CSPG4, COL4A2, SMAD6, PKN1, HPCAL1, PECAM1, EDNR8, ENG, and VIPR1). Conversely, expression profiles of genes identified as being decreased with COPD in four other cross-sectional studies were enriched among the genes that had decreased expression with increasing regional emphysema severity (FIG. 3E). Expression profiles of genes that were found to be up-regulated with COPD in Golpon et al (American journal of respiratory cell and molecular biology 2004 31:595-600) were also enriched in genes that increased in expression with increasing regional emphysema severity. Contrary to expectation, genes that were found to have increased expression in COPD phenotypes by Ning et al., (PNAS 2004 101:14895-900) and Wang et al., (American journal of respiratory and critical care medicine 2008 177:402-11) were enriched among genes that are down-regulated with increasing regional emphysema severity.

Example 3

The Relationship Between Emphysema Severity and TGFβ Signaling

Relationship Between Gene Expression Profiles Associated with Regional Emphysema Severity and TGFβ-Induced Gene Expression Signatures Several members of the TGFβ super family were among the genes that had decreased expression as a function of regional emphysema severity. These genes included ACVRL1, ENG, TGFBR2, and SMAD6. Other components in this family, including BMPR2 (FDR q-value=0.125) and SMAD7 (FDR q-value=0.223), also showed evidence of modest down-regulation. In contrast, SMAD1 showed evidence of modest up-regulation (FDR q-value=0.101). To determine whether the TGFβ pathway might be affected by emphysema pathogenesis, previously published studies that had examined the effect of TGFβ on gene expression were used to develop a collection of gene expression changes associated with perturbations in TGFβ pathway activity (Malizia, A. P. et al. American journal of physiology. Lung cellular and molecular physiology 2008 295:L451-60; Chambers, R. C. et al. The American journal of pathology 2003 162:533-46; Classen, S. et al. Journal of immunology 2007 178:6931-40; Koinuma, D. et al. Molecular and cellular biology 2009 29:172-86; Qin, H. et al. BMC systems biology 2009 3:73; Renzoni, E. a et al. Respiratory research 2004 5:24; Verrecchia, F., et al. The Journal of biological chemistry 2001 276:17058-62) Genes that exhibited significantly decreased expression with increasing emphysema severity were enriched in genes that were induced in response to TGFβ treatment in a total of three datasets (FIGS. 6A-6C).

Figure 5:
FIG. 5 depicts correlations demonstrating the relationship between gene expression changes associated with Lm and those induced by TGFβ treatment of A549 cells (Malizia et al., American journal of physiology. Lung cellular and molecular physiology 2008 295:L451-60). The gradated bar represents the fold change between cell lines treated with and without TGFβ for 11910 genes. The vertical lines represent the position of genes associated with regional emphysema severity in the t-statistic ranking. The height of the vertical lines corresponds to the magnitude of the running enrichment score from GSEA.
Figures 7A, 7B, 7C, 7D:
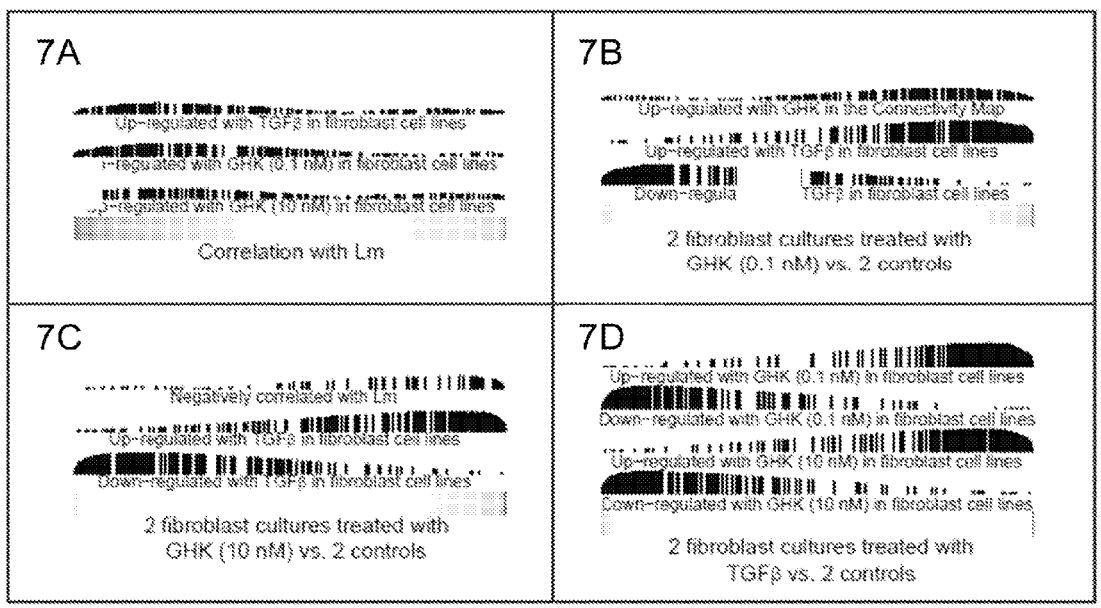
FIGS. 7A-7D depict the relationship between gene expression changes associated with regional emphysema severity (Lm) and the gene expression changes that occur when fibroblast cell lines are treated with GHK or TGFβ. The vertical lines represent the position of genes associated with regional emphysema severity in the ranked gene list. The height of the vertical lines corresponds to the magnitude of the running enrichment score from GSEA. Enrichments with an FDR q-value <0.05 were considered significant.

Similarly, the sets of genes most induced by TGFβ from these three datasets as well as another four datasets were enriched in genes whose expression decreased as a function of emphysema severity (FIG. 6D). As an example, the enrichment of genes associated with emphysema severity in the data from Malizia et al., (American journal of physiology. Lung cellular and molecular physiology 2008 295: L451-60) is shown in FIG. 5 (include the following genes ABTB2, PODXL, EPAS1, HPCAL1, TP8T2, KRT7, COL4A2, COL4A1, NEOD9, NDEL1 and RCOR1). To validate these findings in vitro, human lung fibroblasts were cultured with and without TGFβ1 and found that the set of genes most induced by TGFβ1 were enriched among genes that decrease in expression with increasing regional emphysema severity (FDR <0.05; FIG. 7A). Immunostaining localized Smad2, a member of the TGFβ pathway, to the alveolar and airway walls while members of the BMP pathway including Smad6 (positive staining) and Smad1 (weak staining) were primarily seen in vascular endothelial cells (data not shown).

RT-PCR Validation of Gene Expression

Fourteen genes whose expression is significantly correlated with regional emphysema severity or transcription factors that are highly connected to these genes in the relevance network (FIGS. 2A-2C) were selected for RT-PCR validation (Table 7). Three of the subjects with severe emphysema (6965, 6969, and 6970) were used with four tissue cores per patient. Twelve out of the fourteen genes had significant correlation between the expression values derived from the array and RT-PCR (Pearson correlation; p<0.05).

TABLE 7

RT-PCR Validation of 14 genes

| Gene | Direction | ANOVA p-value |
|---|---|---|
| CD79A* | Induced | 0.02 |
| CCR7* | Induced | 0.01 |
| CXCL13* | Induced | 0.1 |
| BCL11A | Induced | 0.84 |
| TBX3* | Repressed | 0.01 |
| SMAD6* | Repressed | 0.02 |
| S100A8* | Repressed | 0.09 |
| WFDC1* | Repressed | 0.05 |
| ACVRL1* | Repressed | 0.02 |
| FOXF1* | Repressed | 0.03 |
| GATA2* | Repressed | 0.09 |
| EPAS1* | Repressed | 0.06 |
| KLF13* | Repressed | 0.36 |
| TAL1 | Repressed | 0.08 |

The asterisk indicates that the correlation was significant between the expression values derived from the array and from RT-PCR (Pearson; p<0.05). Column 3 shows the p-value for the correlation of RT-PCR derived expression values to Lm by ANOVA.

Immunohistochemistry for CD79A

In order to investigate whether the up-regulation of components of the B cell receptor signaling pathway is associated with a change in the volume of B-cells in lung tissue, the volume fraction (Vv) of CD79A protein, a marker for B-cells, was quantified in relation to Lm by IHC. CD79A-positive B cells were observed in the alveolar and small airway wall tissue by immunohistological staining (data not shown). Vv was quantified in alveolar tissue for all 64 samples and in small airway tissue for 43 samples that contained small airways suitable for histological analysis and was found to be positively correlated to Lm in both the alveolar and small airway wall tissue (p<0.001), indicating that B cell abundance increases as emphysema severity increases.

Example 4

Identification of GHK as a Therapeutic Compound

Connectivity Map

In order to discover potential therapeutic compounds for the treatment of emphysema, the CMap[8], a compendium of microarray experiments that measure the effect of many compounds on gene expression in cancer cell lines, was employed. Query signatures of genes related to regional emphysema severity and/or COPD were derived from gene expression patterns changing with increasing regional emphysema severity in this dataset or gene expression patterns correlated to lung function measurements in four other COPD datasets (Golpon, H. A. et al. American journal of respiratory cell and molecular biology 2004 31:595-600; Bhattacharya, S. et al. American journal of respiratory cell and molecular biology 2009 40:359-67; Spira, A. et al. American journal of respiratory cell and molecular biology 2004 31: 601-10; Wang, L-M. et al. American journal of respiratory and critical care medicine 2008 177:402-11). Five additional datasets were used to create query signatures of gene expression changes associated with TGFβ treatment (Malizia, A. P. et al. American journal of physiology. Lung cellular and molecular physiology 2008 295:L451-60; Classen, S. et al. Journal of immunology 2007 178:6931-40; Koinuma, D. et al. Molecular and cellular biology 2009 29:172-86; Qin, H. et al. BMC systems biology 2009 3:73; Renzoni, E. a et al. Respiratory research 2004 5:24).

Among the CMap data, gene expression changes resulting from treatment with the tripeptide GHK were anti-correlated with expression patterns associated with increasing regional emphysema severity (p=0.006) and the COPD-related expression patterns observed in Bhattacharya et al., (American journal of respiratory cell and molecular biology 2009 40:359-67) and Goplon et al., (American journal of respiratory cell and molecular biology 2004 31:595-600). In Spira et al (American journal of respiratory cell and molecular biology 2004 31: 601-10), the gene expression changes induced by GHK were anti-correlated with to those associated with FEV1/FVC (p=0.0002) but positively correlated to those that change between cases and controls or with DLCO (p<0.05). In addition, GHK-treatment resulted in similar patterns of gene expression to those observed after TGFβ treatment of cell lines by Malizia et al., (American journal of physiology. Lung cellular and molecular physiology 2008 295:L451-60) (p=0.004).

Figures 8A, 8B:
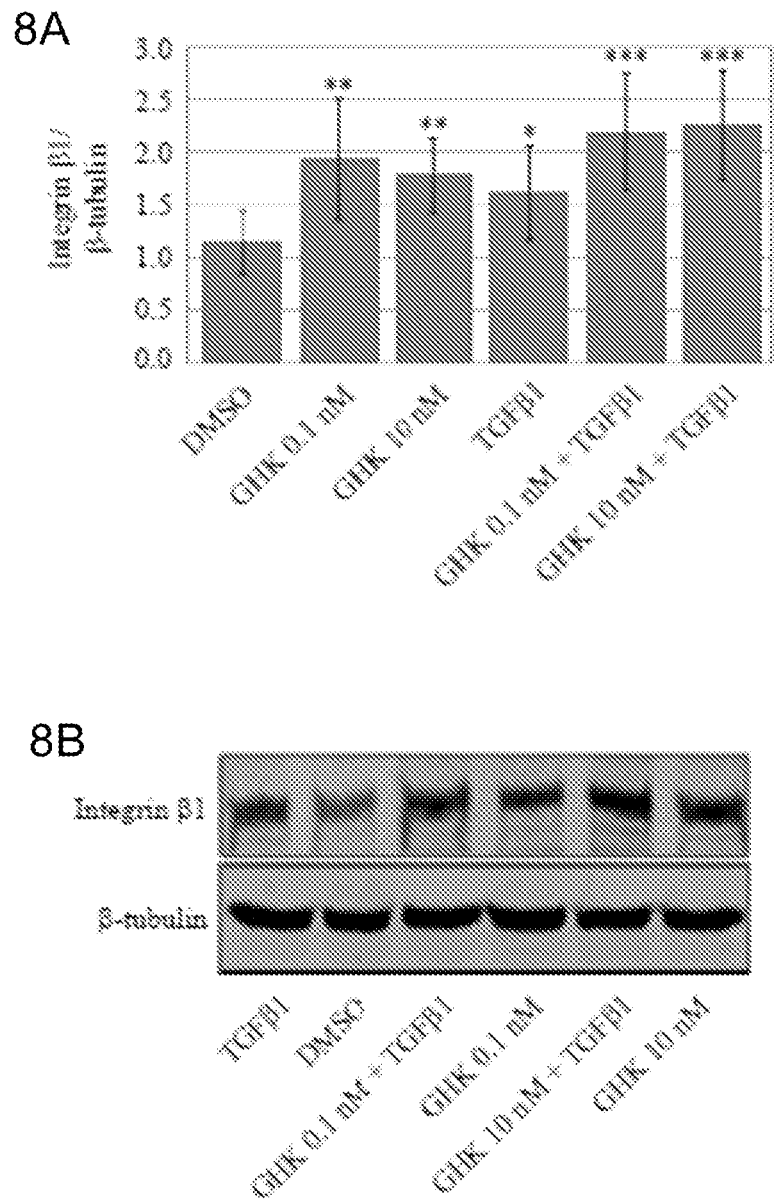
FIGS. 8A-8B demonstrate the effect of GHK treatment on gene expression in human lung fibroblasts (HFL-1).

As the effects of GHK on gene-expression reported in CMap were measured in cancer cell lines, GHK treatment was verified in human lung fibroblasts. HFL-1 cultures were treated with GHK at two concentrations or with TGFβ1. Gene expression profiling of these cells demonstrated that the 200 genes most induced by GHK at 1 μM in cancer cell lines in the CMap dataset were enriched among genes that increase with treatment of GHK at 0.1 nM in HFL-1 cultures by GSEA (FIG. 7B). Furthermore, genes whose expression is decreased with increasing emphysema severity are enriched among genes induced by GHK at 10 nM (data not shown). Similarly, genes that increase after treatment of GHK at either concentration are enriched among genes whose expression decreases with increasing emphysema (data not shown). Genes whose expression is altered by GHK treatment at either concentration are also enriched among genes that change with TGFβ1 treatment (FIGS. 7B-7D and data not shown). The expression profile for ITGB1, an integrin important for fibroblast migration and adhesion, was significantly down-regulated with increasing regional emphysema severity (p=0.0008) in lung tissue and significantly upregulated with treatment of GHK at 0.1 nM in the HFL-1 (p=0.004). The protein levels of ITGB1 were also significantly induced with treatment of GHK, TGFβ1, or GHK in combination with TGFβ1 suggesting that GHK can modulate repair processes (FIGS. 8A-8B).

Example 5

Discussion

By measuring gene expression from regions of varying emphysema severity within the same lung, the effects of systemic differences between individuals are minimized. Herein, by using a morphologic measurement of airspace size (Lm) which reflects the degree of alveolar destruction, the gene expression changes observed were specifically related to the emphysematous component of COPD. While HRCT scans are currently the standard method for grading the severity of emphysema both within and between individuals, a close relationship between emphysema as measured by HRCT scans and Lm as measured by micro-CT has been previously reported (Hogg, et al., Proc Am Thorac Soc 2009 6:546-9). The inventors' analysis of 8 specimens per lung representing different degrees of emphysema from each individual increased the power to detect gene expression changes associated with regional emphysema severity and relate these to gene expression differences that have been observed between individuals with varying degrees of COPD and/or emphysema.

Identified herein are genes whose expression change as a function of regional emphysema severity. Herein, the inventors have demonstrated that progressive emphysematous destruction in COPD is associated with the down-regulation of genes involved in or downstream of tissue remodeling and wound repair pathways, suggesting a role for defects in ECM homeostasis and angiogenesis in the emphysematous destruction that occurs in association with chronic inflammation in COPD.

Also provided herein is a compound, GHK, which significantly reverses gene expression patterns associated with increasing emphysema severity and with increasing COPD severity. GHK treatment also induced a pattern of gene expression similar to that resulting from TGFβ pathway activation. These findings were replicated in human lung fibroblasts. In addition, the protein level of β1-integrin was increased with GHK treatment. Fibroblasts treated with GHK in combination with TGFβ1 produced significantly higher levels of β1-integrin compared to fibroblasts treated with TGFβ1 alone (p<0.01).

All references described herein are incorporated herein by reference.

SEQUENCE LISTING (504 sequences)

SEQ ID NO: 1 - DNA, 3879 bp, Homo sapiens
atcagacgcgcagaggaggcggggccgcggctggtttcctgccggggggcggctctgggccgccgagtcccctcctcccgcccctgaggaggaggagccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcaaaaaaaaaa

SEQ ID NO: 2 - DNA, 3859 bp, Homo sapiens
ctaggcggcggcggccgggtccccaaggctgggcgctgcttgcggaaccgacggggcggagaggagcgtggcgggaggaggagtaggagaagggggctggtcaagggaagtgcgacgtgtctgcggagcctttttatacctccttcccgggagtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaaaatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaaaaaaaaaaaaaaaaaa

SEQ ID NO: 3 - DNA, 1396 bp, Homo sapiens
agccaccatcgaggaaggggcatgtgctggacgcggacacatgatccgagggaccctgctgggtggaactaagaaagtccagcagactgtgcatgctcctgtccccactcacaggcccacgcagcgaggggggcccctcttctgtgtgcgtctggaaggtcgctgcccagggaggaaatgcctttaaccggcgtggggccgggcagctgcaggaggcagatcatccgggctctgtgcctcttgctacttctcctccacgccggctctgccaagaatatctggaaacgggcattgcctgcgaggctggccgagaaatcccgtgccgaggaggcgggcgcgcccggcggcccccggcagccccgagcagaccgctgcccgccgcctccgcggacgctgccccccggcgcctgccaggccgcgcgctgtcaggcggactccgagtgcccgcggcaccggcgctgctgctacaacggatgcgcctacgcctgcctagaagctgtgccgcccccgccagtcttagactggctggtgcagccgaaacctcgatggcttggtggcaatggctggctcctggatggccctgaggaggtgttacaagcagaggcgtgcagcaccacggaggatggggccgaacccctgctctgtccctcgggctatgagtgccacatcctgagcccaggtgacgtggccgaaggtatccccaaccgtgggcagtgcgtcaagcagcgccggcaagcagatgggcgaatcctacgacacaaactttacaaagaatatccagaaggtgactcaaagaatgtggcagaacctggaaggggacaacagaagcactttcagtaaagcaacggcaagcagctaggttgcaagaacattcctctactttctgctaagccttggaaacagttgggaaaagtagtttgaccctcacagttcacattcagctcagcagagcaagaccccagagatgcttagagacaggacacctggccctcaaacccagtttggcccagcctggttgggtgactttgtgggagccacttaacagctctgggtccctgttttaccatcctgggagcaaggccctgcagctccacgagacctttaccccgggaagaagccgccgcccatgaaagcatttctgaagcccctttctaagacaaggctcagcatcttgatatttttgacagattcctcccaagtctggctctgggaggtatgtacccatctcaaatgttcccaagataaattcatccttcaggaaatggaaatgaacttgcttactaatgtgtgattcctagttgtagccaccggatgtgctgaggcctaaatgttagcaggtgggaggaggccacagaacaataaaaacaaccaaataagaaaaaaaaaaaaaaaaaaa

SEQ ID NO: 4 - DNA, 1947 bp, Homo sapiens
acagtgtccagaatgctggagcgtaggtgaaaggacaaaagccagacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaaggaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttacctttacatgtttttcttttgaaatggatggagttctacctgcatgtcacagcactttgcattcatgattattagcttgaaacagtcagaaaaaagatggatgggtggagacagacaaggaagaggctccttggttcctagaggagtttccaaattctaggagaccctagagatgatccagtataacccctggtgtcacagaaacagacggagtccaaggtgggttcagctgcttgcctgaagtcagagttatctggtagacaacagcagtgggacttagatgtcttttt

SEQ ID NO: 5 - DNA, 2420 bp, Homo sapiens
agaatggcctcggacacccaggcagtccctgacgtgtcggggaggagccgggcgcggaggtacgctgagtggagctcggggctgcgtaggggagctgagccgagcggctgggcgggcctggccgggccggcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaagggcaagaaaaagtcatatttcccacgttgttcatggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaaggaaaaaaaaaaa

SEQ ID NO: 6 - DNA, 5929 bp, Homo sapiens
tttctttttaaaaatcgctgggtctgttgagctgtcctgggctgggtgccttgctctttgactgagactggagacagacggcaacagccacaggcagactgaggtggcaataggaaatctgccgagatgttcagtcaggtgcccaggaccccagcctcaggctgctactacctaaattccatgacacctgagggccaggagatgtacttgcgatttgatcagactacaagacgctctccttacaggatgagccggattctagcacgccatcagctagtgactaaaattcaacaagaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatatctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaatttatatatattaaatatttcctattttctataaaataaaa

SEQ ID NO: 7 - DNA, 4550 bp, Homo sapiens
acaacagtgagctcagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcattacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagttgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagtcaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcaccttagtaagcaccttctaatgctgcattttttttgttgttgttaaaaacataccagctggttataatattgttctccacgtccttgtgatgattctgagcctggcactcccaaatctgggaagcatagtttatttgcaagtgttcaccttccaaatcatgaggcatagcatgacttattcttgtttggaaaactcttttcaaaactgaccatcttaaacacatgatggccaagtgcccaaaagccctcttgcggagcaaatttcagaatatatatgtggatccaagctctgatagttcaggtgctggagggaagagagacctgtgtgtttagaggccaggaccacagttaggattgggttgtttcaatactgagagacagctacaataaaaggagagcaattgcctccctggggctgttcaatcttctgcatttgtgagtggttcagtcatgaggttttccaaaagatgtttttagagttgtaaaaaccatatttgcagcaaagatttacaaaggcgtatcagactatgattgttcaccaaaataggggaatggtttgatccgccagttgcaagtagaggcctttctgactcttaatattcactttggtgctactacccccattacctgagggaaactggccaggtccttgatcatggaactatagagctaccaggacatatcctgctctctaagggaatttattgctatcttgcaccttctttaaaactcacatatgcagacctgacactcaagagtggctagctacacagagtccatctaatttttgcaacttcctgtggccagtgtgtataaccccttccactatctcacagatagtcacagcgtccattccatagtctgtctcctcacatctgttagtattgacacagcacagacaccacaagccatcaggttcttcatggggcaggtgaaatacttctaccccatgggtaaatgtattcacatattaccaagagaagaagcacattatctatgatcttttggcccagttcttatttagcatttttattccagcctacttggaaacatgtttttatttgcaatatatgcctgactgaattaagcttgcttgttttaaacaaccaaatcattggaacagaaaaggatttaaaaaacaagaatgcatgatctcagagtgattaaaaaaaaatcagtggaaataaatgatcatagaaggtgcttttcaaaacaactgctattataattctcaaagtcctactctgccaaaagaagattaaaagtcatacattacattacaaggaaatgttcatgtgggaagagggttgctgaaaatcaacaacgcttgaagttaaaaagtgtgtctttgtagatttcattgtataatgtgtatttcttaggagatggctgacttgattgatctacgctaagtggagacatttcacatttttaaaaccaaatgttcaatctgtattactctttgccgtcttgtatgtagaggctatttttaaatcattaaatttttagatctctgttttcataaaaaaaaaaaaaaa

SEQ ID NO: 8 - DNA, 2424 bp, Homo sapiens
gttccccgcgtgccaccaggaagctcgggccggccaagagcgtagactcttgagaggagtgagacaggtgcgcgccagccggccttcggggctttatgggaactgggccgtgcggcggtcccgccctcgtgcgcaggcgcagaaccgttgtgaccagagcggttgcgggctgagcggtttcgagccggcgtcggggagcggcggtaccgggcggctgcggggctggctcgacccagcttgaggtctcggcgtccgcgtcctgcggtgccctggggtctcccgaggaccttgtacccgcgcggcttccttgggctggctttggacgacgctttcgccttcctgctgcctaggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagcccaggaggtcaaagctgaggtgagccatgattactccactgcactccagcctgggcaacagagccaggccctgtatcaaaaaaaaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaagaataaaaaaa

SEQ ID NO: 9 - DNA, 4296 bp, Homo sapiens
acattccggtgggggactctggccagcccgagcaacgtggatcctgagagcactcccaggtaggcatttgccccggtgggacgccttgccagagcagtgtgtggcaggcccccgtggaggatcaacacagtggctgaacactgggaaggaactggtacttggagtctggacatctgaaacttggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccctttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctgggaaaaaaaaaaaaaa

SEQ ID NO: 10 - DNA, 6817 bp, Homo sapiens
gcgcggcgaagctgcggccgcgacttggcgaggtggtccctaacgttgccgctcggcatccttagaaccggccgcccctgacgccgcgcggggaccccagtcgcccgcgcgccccatgcgctcactcttcggtgcccggccgggccggcgcctcgcagacgcggagccgcgcgggtgacggcacaggcggctgcgcgcccagcccagcccagcccagcccgaggagagggcgcgccgcgcccccgccccccgcccgctctcccgaggccgtgggtgcggatgcgcggctgacgactcgcagcaagagcaccgccgccggccccagcccgcagcatggcagccgccgcctatgtggaccacttcgccgccgagtgcctcgtgtccatgtcgagccgcgcggtcgtgcacgggccgcgggaggggccggagtcccggcccgagggcgcggccgtggccgccacccccacgctgccccgcgtcgaggagcgccgcgacggtaaggacagcgcctcgctcttcgtggtggcgcggatcctagcggacctcaaccagcaagcgccggcgcccgccccggcggagcgcagggagggcgccgcggcccggaaggcgaggaccccctgccgcctgccgccgcccgcccccgagcccacctcccccggcgccgaaggcgcggcggccgcgccccccagcccggcgtggagcgagccggagcccgaggcggggctggagcccgagcgggagccggggcccgcggggagcggcgagcccggcctcagacaaagggtccggcggggccgaagtcgcgccgacctcgagtccccgcagaggaagcacaagtgccactacgcgggctgcgagaaagtttacgggaaatcttcgcacctcaaggcgcacctgagaactcacacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgttaaaaaaacaaaaaaaacacaaaaatttcaaaaaacaccacccaccaaattgcacaatagatacacccacaaagttgagattcagcgttgttgaaccccctttctcagggatggacacgtttcacgaggtcagtgaggacaccccttcctgccgccttactctgtacatagatttgcactctggagttttctgttaggttcgggaacacgctggggacagagcaggccagccagtctggtggagctcagcgtctggctggctggccagcctgtgggtctgttgggagcagatgtgctcactgacgtttgtgcctccagggcagattcctaagcagctggcctgacctcttcctgcccagcccccaacccagtctctggcctctgcccaacgagcctggctgggcttgcaacgcagctgattctgagacaggcccctgcagagggatgccttaaagctgtccctggctggaggagcactccaccttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcatgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccctgggacctcagagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttaccactgtgtgtcagctgggattggccgacagcgtggtggtgacttctaggtagaccgatggaccctaaattgggcagtggcattgtttctgctgtggtgggaactggcagggagagggtcacctccactctggttggatgcggagctggtccctctggctgccatgctgtgttggggctctctgacctccctgcttgcattgggtctgggagagagagtggaatatttggtagggaccttgacagaagagagccctgggtgcttgtggtgcaaagatcttcatgcccagttccaaagtgaggtccctcccaaagttgttttcgtgtgaggcagagaaagccacactctgaatacattttatgtctcaggaattcacattccaggttcaggaattttattccaaagtcctttggtgcactcaccgtccaccgttccccaaggcagggagagggagtggcccgtccctgggaggctggcaaagtgctctccagggaggggtcagacgtccttgtgatctgcccagggtgtcacggaaggagattttctagctccacatctgtctgcacataggaaggaaaagataggactctaaacctagtcatcttggaataaaaagaagagctggtttgttttagagcagggcggggggtgggggagggaagcgggtgttggctgtttccaaagagagcacttaatttaatttttcctttaaatgacccagggctgttccgtctgatagatggaagggtaacattgccttaaaacagaaatatgcaggcgttggctatttttggcataagagcgtgtcttcattcccaaagtggttctcgtttaatggcagggtgcggtccttaggccccggcctggactgggaaatgggggtagggcaccaggagagaaatcctcctgggtactcctggccagaccctcctgaatcatctgcggcttaaactcatctcgcttgaagggcagggagaaacccatgaatctcaggcacggttcacaggggtcctcaagggcaggtttccatttcatcatgaagtgagggactcctgtggaagagggtggtgggccttggaacgctgcctccactgaggcgggcacacaaggcggaccctcctgaaacagcctccattttcttcaaacatgcagaatgttttcccagactgcgtctatttcagggtcttccatttttgtggtttatggccatgcttgccagttttggtggggttgaggaacccataggactcatagaaataatagtgaaaactcaaacccttattttgggacttcagttctcgtggtccataggggcagagatgtcaaagtgaaggttgcctgagtgaagggagagttcccctataaaaggcctaaaattgatctggggctcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactcctaaccctgactttattcccaggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaagctaaaatctgaggcgtgggctgatggtttttgaaatcaggattaccccaggaagaaccaggtcctattactaattttcctgattctgaggctctgaaggcttgtctgagacacattccggagacctttgtaccagaacttggatgcatagtccaccttactactgatacacgcctgagcaccctttagggcgaggcgccgcctcctgcctgctgtcctgtccctcagcatcagaagagttgaattcagcaggagacgggagcccggtgtccatgagggaagaggggtcgcgcttggtttctactgacccccatgaagatttcagacttgcagtgcggccacctggccctgccctgcctctctctttctcatacagctttaaaactttactacttttatttaaaaatgaactggatgggagagaagtagcgtcccctaccctacaagtcacacattccggggaggggggtggggggtggaggcaggaagtcatgggggtgggggtgggagcacgggaacagctttcttaaggcctcagggtcctgttttccctggcctcttctagagggcccgtggacaggtcgcagtgcgtgcttatttggaaaccaggtgtgtgagccgaatgcctgccaggccatgcactcagcagaggagcccttgtacctggctgccctgagaggagcaagaggccacctcccatgtggctctagacaccacgtgggctcattagccccagcgtctgtgccggctccaggtgcctgcctctgggtgtgtgagtgggagactttgctccctggcctcatcctagagaggcccctggtgcctagtgctgaggcctctggggctggaaagcctcagcagaaaggaggcactactgagcaactatgcattgtcattgtcgggtttggggctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggcttgctcggataaaactttgtatgtattttgtatggcatagattctatattgtaatgatgtcctatgcaaaaagaaaaattaacgaaattgtaaattttattgttttaacgtgtatgcatgtttagtgacgtttacattttgaaataaaatttatgattcattattttaaaaaaaaaaaaaaaaaa

SEQ ID NO: 11 - DNA, 3108 bp, Homo sapiens
gcctctggctcctcagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtgcttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaataaaaaaaaaaaaaaaaaaaaaaaaaaaaaaaaaaa

SEQ ID NO: 12 - DNA, 3057 bp, Homo sapiens
gctgttctgccccgcgggggcatccgctgggtccccgcgccgttgtcaagaccggggacctggacgcagcggagagaggtgccgccgcccgccccgtccagtcgccgcgcgcaggcactgcagtcagcggtgaactgacttcatcccaatccctcagcccccaccaggaccagtctggagtccctcccctgcccccattgaaatttcccttccgtccccaaacttacctctgatctagaccttactcacctccttcctgtttcctaagactccttcctgccgtccacagaccgagccttttatctttgtccaccctgtgccagacacctccttttccagaaccttctccttactggtgaccttacttatctctgttgctttctggggtcctaggaaatgccagcactcccacccacattgcctgaactttccaacactccctaactgcgctgtgtcctatctcaacactttctcatgtatttcttgtgtcttctagaacattcccccgccattattacttcaatatggctacacatacttcctaattgccctgcaaaccatctccttctcaccattgcccagcgatgctttcgtctcctccataaacactcccggagaccaatttttgtgtcacccccatactccctcgttgacacactgactccatacataacctccttgaaaaacctctttattaatctcaccatcctccagacttccctcctgtcataattccatccctcctccaacttttccctctcaagctctgcccttcccagcccagcccagcctacccaacctcatctcttccctgtagaccacatcccaccatgttcccctgagcctccaaggaaggggctcagggggccccatggcctcccgctccctgtggccccacagcccccgtgggccaggggaagcgccccagaagccgaagtgcccaccatgggcaaccacacgtgggagggctgccacgtggactcgcgcgtggaccacctctttccgccatccctctacatctttgtcatcggcgtggggctgcccaccaactgcctggctctgtgggcggcctaccgccaggtgcaacagcgcaacgagctgggcgtctacctgatgaacctcagcatcgccgacctgctgtacatctgcacgctgccgctgtgggtggactacttcctgcaccacgacaactggatccacggccccgggtcctgcaagctctttgggttcatcttctacaccaatatctacatcagcatcgccttcctgtgctgcatctcggtggaccgctacctggctgtggcccacccactccgcttcgcccgcctgcgccgcgtcaagaccgccgtggccgtgagctccgtggtctgggccacggagctgggcgccaactcggcgcccctgttccatgacgagctcttccgagaccgctacaaccacaccttctgctttgagaagttccccatggaaggctgggtggcctggatgaacctctatcgggtgttcgtgggcttcctcttcccgtgggcgctcatgctgctgtcgtaccggggcatcctgcgggccgtgcggggcagcgtgtccaccgagcgccaggagaaggccaagatcaagcggctggccctcagcctcatcgccatcgtgctggtctgctttgcgccctatcacgtgctcttgctgtcccgcagcgccatctacctgggccgcccctgggactgcggcttcgaggagcgcgtcttttctgcataccacagctcactggctttcaccagcctcaactgtgtggcggaccccatcctctactgcctggtcaacgagggcgcccgcagcgatgtggccaaggccctgcacaacctgctccgctttctggccagcgacaagccccaggagatggccaatgcctcgctcaccctggagaccccactcacctccaagaggaacagcacagccaaagccatgactggcagctgggcggccactccgccctcccagggggaccaggtgcagctgaagatgctgccgccagcacaatgaaccccgagtggcacagaatccccagttttcccctctcatcccacagtcccttctctcctggtctggtgtatgcaaattgtatggaaaaagggctgtgttaatattcataagaatacaagaacttaggaagagtgaggttggtgtgtcactggtcaacctttgtgctcccagatcccatcacagtttggcgattgtggagggcctcctgaaggaggagatgagtaaatatatttttttggagacagggtctcactgtgttgcccaggctggagtgcagtagtgcagtcgtggctcactgcagcctccacctcctgggctctccagcgatcttcccacatcagcctcccgagtagctgggaccacaaatgtgagccaccatgcctggctaatttttgtactttttgtagaaatggagtctcactatgtttcccaggctgatcttgaactcctgggctcaagagatcctcctgccttggcctcccaaagtgctcagattagagatgtgagccgccatgtctggccagataaattaagtcaaacatttggtttccagaaaataaagacaaatagagaaggttagatttttttttttccaacaagtggataaaagtctgtgactcgggggaaagtggaaggagaaatgcagccgatatagagtcattatgtttgcaaagcccctggtcatacaggccagggaacataagaccgcaattctaagtttctagataaacagcgatctccaagtcaagactgaggatgaagagggagaatgtcagaactcaagtgaagggcaatcagggcagactgcctggaggagtgatgccagaaggtttgggaagaaggtgtgggacaagaagaaagggtatttattcattcattcaacagaggtttatgtagggcactgtgctgggtggggctggggacacaacaatgactgaggcagcctggccttgccttcacagggctcaccatacacaagtaaataaaaaatatgtaatgtttggaattgctaaaaaaaaaaaa

SEQ ID NO: 13 - DNA, 6351 bp, Homo sapiens
cggcccagccgagccgggctgcttgtctggccggcggaggctgagcgcgaccctagcaagccgcggcgcccgccgaccagggacaagagcgactcctgggaccccactctgccccgcgccgccgcctcctcccctgttgtcgcggggacgctcaggcccgcgccgcccgggccacgattctcctcctctttctcccggaggggaaggaacggagaaagccgagcggcggctccgggagagagcgagccgaggcccctgcccccgaggctcggggcaggaggaggaggaggaggaggaggcggaggcggagggaagtgcgcgtcactctcgggaggagagtatttcacctccaggcagaggctgcggctgccagttgagtacgagcggcagctgcgggcgccggcaatcgagtggcttcctggccatggagaggagatctggacccgaggacgccagggactcctctccgtctccctggaccgctgtgtaggcacctgagttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttctaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgttttttttttttgtatattgatgaatgagatcttacctattaaatatattattggattatggttcctgaaggtcattagagtgtgtgtgtgtgtgtgtgtgtgtgtgtgtgttttatgacttaaatatctttacgtgtgttttttagagcttggttctttaaagatttggagaagatatgtaaattaccaaggcacttggtttttctgttttatatactaataatcagggcctaagttaaataaaaatatgtgtgcatgtattttaaaaaaaaaaaaaaaaaa

SEQ ID NO: 14 - DNA, 3320 bp, Homo sapiens
agaccgccgctgctgtctgcggggtctggtgccggggcctgagtctctgctggctaagccgacgcctcagccgcctcagtcgcctcaatctcgccttccgccctcgctctccctccgcgccaccggaccccgtagccccgcgcgcccccagacctttaagccagatgatgaacttcctgcggcgccggctgtcggacagcagcttcatcgccaatctgcccaacggctacatgaccgacctgcagcggcccgagccccagcaaccgccgccgccgccgccccccggcccgggcgccgcctcggcctcggcggcgcccccgaccgcctcgccgggaccggagcggaggccgccgcccgcctcggcgcccgcgccgcagcccgcgccaacaccgtcggtgggcagcagcttcttcagctcgctgtcccaagcggtaaagcagacggccgcctcggctggcctggtggacgcgcccgctcccgcgccggcagccgccaggaaggccaaggtgctgctggtggtcgacgagccgcacgccgactgggccaagtgctttcggggcaaaaaagtccttggagattatgatatcaaggtggaacaggcagaattttcagagctcaacctggtggcccatgcagatggcacctatgctgtggatatgcaggttctccggaatggcacaaaggttgtccggtccttccggccagacttcgtgctcatccggcagcatgcatttggcatggcggagaatgaggacttccgccacctgatcattggtatgcagtatgcaggcctccccagcatcaactcactggaatccatatacaacttctgtgacaagccatgggtgtttgcccagctggtcgctatctataagacactgggaggagaaaagttccctctcattgaacagacatactaccccaaccacaaagagatgctgacactgcccacgttccctgtggtggtgaagattggccacgctcactcaggcatgggcaaggtcaaagtggaaaaccactacgacttccaggacattgccagcgtggtggctctcacccagacctatgccactgcagagcctttcattgactccaagtatgacatccgggtccagaagattggcaacaactacaaggcttacatgaggacatcgatctcagggaactggaagacgaacactggctctgcgatgctggagcagattgccatgtcagacaggtacaaactgtgggtggacacctgctctgagatgtttggcggcctggacatctgtgctgtcaaagctgtacatggcaaagatgggaaagactacatttttgaggtcatggactgtagcatgccactgattggggaacatcaggtggaggacaggcaactcatcaccgaactagtcatcagcaagatgaaccagctgctgtccaggactcctgccctgtctcctcagagacccctaacaacccagcagccacagagcggaacacttaaggatccggactcaagcaagaccccacctcagcggccaccccctcaagggggccctgggcaaccccaaggaatgcagcccccaggcaaggtgctgcctccacgccggctcccccctggaccatcactgccaccttcctcctcttcctcctcttcttcctcctcctcggctcctcagcggccgggcggccccaccacccacggagatgcaccctccagcagcagctccctggcagaggcccagccacccctggctgctccaccacagaagccccagcctcacccacagctcaacaagtcgcagtccctgacaaatgccttcagcttctctgagtcctccttcttccggtcttcagccaatgaggatgaagccaaagcagagaccatccggagcttgaggaagtcctttgccagcctcttttcagattagctcttcagacacacggggcacccagcccaaccgggaaaggcatctaagacattcaccaacaacagtcagccagcttggtggttatgtcccatgaccttgacgtgtgtggtcccttcctctgctctgttgtactaagtgatgttgtgcagcccagaaaggaccatttgacagtctcagggcaggtgcctacccagcaaggggtacctggcatcagagaggaaagagctgcttccctgtagtcatgagagcttccttctgaagtcatcgttcgctgtgagtttagtggccttattgtgacagtgccatcatgtcttattcttccctgtgaaaccaggattaatcgtggactcctggcagcttaacctagctcagttgcagtgctaagcatgccccgcccccattcagtgatacctgtttgggaagtatatacttccccaaaagtactcttggccctaagttttaggaactttccccgacctggatcccttgtcatacctgtgttactgtttaaagcacacccacccaacttacaagatcttaggctgctgtggtggtgaagcaccttgagtctgctgatattcgggagaacaaggatctgcagtttccccttttctcccctctgaagagtggttcttatgtgcaatctgcagtaaccttgaactccagagctgcactatagaggagaatgcatgccactatgacagcagtatgccaagctttgtgttcatctcctaataaacgttaagacctttggtgtaataaaagcagcagcattcaccaacatttgattcagccatgaggtcttgaccccttggccaccctttaggctgagagagtgtccatgaggggtgtgtgtgtgtgtgtgcttgagtgtagggagtgaaaaatctaggtgtgtgaagctgtttgtgtcagtttgtgtgtgtgactgcaggtgtacatgtgtttgcaagtgtttgagaatgtgtctgtcctttacataccacttctgggcctcctcgcacctccccagtgaatctgtctcctccaagacacctagccttccttcagcaactcagcgtttctacctatattacggactttgtaacctttcaaataagcacagaacccttgctcccggaggagtcaatttagactcacttgcctggtctatcatcaagctcctcagctgaggcccacatggtggtgccaatgaggctggaccaacctgctctgacaaccaggctcccacagatctcaacgaaggcatcctaaagaggcctgcaattgagggtgggctctgagggatttcactctggctgcttcatgactccctgatactcaagtatattttcccaaagaccacggatgctgtgaagataaacactacatctgcaccaataaaaaatccatatattaaaatgttaa

SEQ ID NO: 15 - DNA, 408 bp, Homo sapiens
cgctccaccacgccgtccacgtgcgccttgcggtctctccatttatcgcttgagatctccagccttaccgcggctcgaaatggaccccaactactcctgcaccactggtggctcctgcacgtgcgccggctcctgcaagtgcaaagagtgcaaatgcacctcctgcaagaagagctgctgcttctgctgccccatgggctgagccaagtgtgcccacggctgcatctgcaaagggacgtcggagaagtgcagctgctgtgcctgatgtgggaacagctcttctcccagatgttaatagaacaacctgcacaacctggattttttttttatacaatactgagccatttgctgcatttctttttatattaaatatgtgagtgacaataaaacaattttgacttgaatctt

SEQ ID NO: 16 - DNA, 4871 bp, Homo sapiens
agtccctgccctcccctggggagggtgagtcacgccaaactgggcggagagtccgctggcctcactcctagctcatctgggcggcggcggcaagtggggacagggcgggtggcgcatcaccggcgcggaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaaaaaaaaaaaaaaaaaaaaaaaaaaaaa

SEQ ID NO: 17 - DNA, 10759 bp, Homo sapiens
attctccgcggcgcggcggcgagtgctggctgcggtaccctcccgctcgcttgtccgtctgcgcgcccgcgatgtgaccagccgactgggggcgggctggcggctctgcctgcggcagcgcatcggtttttctcctggcaggtccctaattgagccgtgattcccttggagccagagacacccaccaggggctcggagcgccgcgctccggggctggaggcagctgcagcgctcgggtccgcgcggccgggtgcagtagcctcagtcccagccgccgcctcgctgagtcgtgtgccctggcgaatgcccggcgcccggcacagctgagccaaggcgactggtgcagagcggcggcgcctggtcctgcacttgccgctgctgccgggctgtgccggggcggcggcgctgcgcgccggagtttgcagaggctgcctccgagcgccgtccgccaggaagactccctgcctcctgagtcccaaaaacacgagatttttctcctatttcagcagttggccacaacttcattgctgggaaaaggccaagaaagaagagagaactctcaccacaacatttcaaagggaatacattgccagaacttggaatactctactggacaaacatttcctccaaggacacagctctctgcctccatgtcaccacctttgaaggactgactgattccctcggctggtgccagtgcctgctcctgccatggggcccgcggggagcctgctgggcagcggacagatgcagatcaccctgtggggaagtctggctgctgtcgccattttcttcgtcatcaccttcctcatcttcctgtgctctagttgtgacagggaaaagaagccgcgacagcatagtggggaccatgagaacctgatgaacgtgccttcagacaaggagatgttcagccgttcagttactagcctggcaacagatgctcctgccagcagtgagcagaatggggcactcaccaatggggacattctttcagaggacagtactctgacctgcatgcagcattacgaggaagtccagacatcggcctcggatctgctggattcccaggacagcacagggaaaccaaaatgtcatcagagtcgggagctgcccagaatccctcccgagagcgcagtggataccatgctcacggcgagaagtgtggacggggaccaggggctggggatggaagggccctatgaagtgctcaaggacagctcctcccaagaaaacatggtggaggactgcttgtatgaaactgtgaaagagatcaaggaggtggctgcagctgcacacctggagaaaggccacagtggcaaggcaaaatctacttctgcctcgaaagagctcccagggccccagactgaaggcaaagctgagtttgctgaatatgcctcggtggacagaaacaaaaaatgtcgtcaaagtgttaatgtagagagtatccttggaaattcatgtgatccagaagaggaggccccaccacctgtccctgttaagcttctggacgagaatgaaaaccttcaggagaaggaagggggagaggcggaagagagtgccacagacacgaccagtgaaactaacaagagatttagctcattgtcatacaagtctcgggaagaagaccccactctcacagaagaagagatctcagctatgtactcatcagtaaataaacctggacagttagtgaataaatcggggcagtcgcttacagttccggagtccacctacacctccattcaaggggacccacagaggtcaccctcctcctgtaatgatctctatgctactgttaaagacttcgaaaaaactccaaacagcacacttccaccagcagggaggcccagcgaggagccagagcctgattatgaagcgatacagactctcaacagagaggaagaaaaggccaccctggggaccaatggccaccacggtctcgtcccaaaggagaacgactacgagagcataagtgacttgcagcaaggcagagatattaccaggctctagcaacccagaagacaaccctgggtagcctgtgatcagtgtctggagacgtttcttctgtggaagagaagaagtgacacaaacctatacttcatatgctgctttagtcacctgaagatggttggagaggccctgtcgactgttctcccagttgttcagtttctgagacagagaggtacggactaggctgcacctgagtgtgcccctgcctgccagatggacaggtacacccaagcacatctccctgctgcaccctcaccacccacaaaagatcccagctgtcagtggtctcatctcattagtgaggaaagccaagctgtatggaaaagctgcactcaccaaggaccacaatgcccccggcctaaagtactgccattcagaaaagcaggtttttcttcctctctttccttttctctgtctgctactgactttaaggctttttcccccttgaaatgtccagattcctgtggttcatcccaaggaaattttcacacaaagcttggcctttgccctcaatataggtgttttaggatggtgacaaaccatggctgctgctttctgcccagctcgccagtcctccccaaagagttgcgcatcagcacctggggatctggaccctgcgggtgaagggatggggagggacgtccctggagtctcttctgtctttgttccttcttattttggcattcgatatcagcagcctctccccaaagtacttgaagtcagttttagatgctttattttatttttctagtcaaaaacgtgtttcccccagtgtttgaaaactcgtccgaatcttttcagtattttccatgagtattgtggtacttctagacttgtttaagcccagaactcattccttcaaaacagagagccttaatctttatgttgggacacagaccacatatttggacggcagccatgcatccatcgctgaagggctgtggacatgaatgtgtatttcccatggtctccgctgcccacaccaacagtgtggcatctcataagttaactgctaccctaaggtaatctaagattaaaatgtaaacatttatttttgttatgtaagtttataagatgttttatgttcaatgcctaatttctcaaaagtgccagaaaaaaatgtatattagctattttgattttatgtacaatgatttatactctccttttgaaaagataccataaagcacataagctagatcactacaaggagctgttatcttttttctaatcaagtgtttaaaacactgatggtttttaaagactcacctttttaaatggtacttggagctcctgattcaaattacctagaccccctagagaaataaatggaatatacataaataatcattttcagtggtttatggtgggcaatattgcaatatttgaaatggtaaaaatggaaagaagaacaaaatatgatgagaggtggctgtgaattataaacctcataaaagtgtcataattccattaaggtttaattatattttttcagaaaacagtgatgaattctgtagtccagtgcttgccaatgcaaattgcctattggaatcttcttcctatattttacaaacatcagtggctgaaatagctcagagtaagagctcagcctggtttgaatttaatcatctctttagatcttataaggccagcattaggaaacttgttcacttttcattttcaaaggagcctagttgaagtgctattatgagtgtgggctatggaaagacagcttttcctacactgataaagaaaaaaaatgaggaaattatttcatccccttgtgacatctgtgactttttggatttaataatcttgctgtttttcctctttatgacaaagaatataattgggaggatgaagtgtcttaaaaattgtagagaccagctcactggaatgtttttccatccctgtattcatggcttgactttgtgactgctctacactgcatgtctgacattgcagagtgagctatgttgaggtaaactggttggttgtcattattttgcaatcagcctggtctctcccatgaagatgtcgtgtgcataagcacaatcatcactgattagaagatcacagcagaatacccttggattagagagaagttcgtaccttgcatttctctgaattctagtctctcataagcactgctttgctggatgattttcactgctttgtgttaatgactttgagcgatctctcacatgatggggttctttagtacatggtaacagccatgtcatcttacacacctagcattgtgaatgctgtagtgacatcctttataggcaccttacagctcaaaacttttgtttcatttcatgccttacttatcaaaaaggcaggaaagtaggtatgatctctaaagtaaaaaaaaaaaaaaaaaaaaaactttttatagaaagctcataaataatcatgtcattttgcaattttgttaccaaaatttcccccaagagttttcaaatattagttctgcaatgtggctatgaaatatgcactgaaatataccttttaatttgagaaccagtggttagaataagctgtgatataaagtattttcagtgtacttttaaaggaactataaggccctccagcataaacgctaaaagaatagatggtagcacaggccatgagggctgggggagagaagcagagtgaaccttagaaagatggctcagctatttggagcactggatattttactgaagttatttactgaggcaccatcactgttttgactgtacagtatagtttttcataaatttcatcacatttactttgttcagaatctgggcttgaatctttgagttggacaaaagcctatggtttcttttaaaaagtttcatcttgagctaatgctacagtttaaataaaatgtatgaaaggtagttatcaaaaacaatttgtatatttaaaattctattttgacatccattttttacagcgaattatagcaggttatgtgaaatttaaaaataaattttaggaaatttttttatcttgtaagtaagaattataaatctatctcagttaaaagtaggatctttgtttttattcagatattttgaaagtttagaagcattttgtatgctactttggtatttcttaagtatagtcagcaggaaagggtaacctgttttatgcaaaatttttttaatttgtcaaatgtttttagtgtgtctactttctgaaatagtctcaatatcctgtctgtatcctaggcagataactacacaagaacaaaacgctatatagaaaagaaaatatttgaggaaatcttaaattccataagaaagtaattcttgcaagaatgttggctacatatttttttttctgtcctgaataaattacatcattaggtctgttgaagcttttgaagctaccactattctttctgggataaaggctaattactgatttatctgccctcaaaatcccagagttaattctaattgagtactaaattaacagtaagtagttaacacagagaactaaaatttaaccgcattatatcactgtatatatttctcatgatttttgctaattagagcatttacttaaccagtaataaactacacacacacacacacacacacacacgtatacgtgtgtgtgtgtatatacttggctctgacacaactctggtgcttaattaggatatgttctattatgtattttgaatgtttatcctgctagtgtgatgaacttttgttggaaaagcagaattagaaggaacagtttttcaatcagtttcatttggtaattacaggaaaaccttgagttgctctaatttaatttttccaattaatacatttagactttaaattgcatccgtaattctcttggctgaaaaacagtggtattttaagacagttttgttatacatgtgacttacttttgactcagcctgagaggaggaaatgtaaagagataagagatttggcccaaagcagcaagagactagtaaccttgagccaggacgaagccaagacaacgtgactcccaagtagcaggagcagaggtcggtcacctgtggcattctgtttcattcccttttaaaattatgagactttataggcagtgtaaaacatcagcaggcagcgatgtgataggatgtgcgaaaaagctggtctgataccatggctataattacagagctttagttcaattaggattttgtaaatgagcaaatgacctttttttccagtgccccttgtaatagttaatatgagtccatgcaatcttgtgatgccattctcctgaaggtgttgatttctggtacccagccagcttagctttggctgctggaagcacagtaggtactgatgattacttcctggaaatcttgacaggcttattgtactgtgtaatggggaaaagttaaagtataatgtttggtgttaataaatgactgatgtgaaaataggaacatgtgtctttaatatcaaatatggctttatttgcagtgaaatctaaattccttattctacagtagtattttcttgccctgtgttgtatattttcctaaatacatttttcctgacagtggctttaggccagttgaacacacttagactgaaagtgtttaacttaaagagatcagtccagaaaccatgataaattagaatctttatctggaattaccaaattaaaatttaaaatcatggtccagaagagaacaaacattcatggttttttttatcctactgctcatttttaggtctgtgtttacatctagtctctactatttgtgaagtatgtcattatttttttcaagttcttctttgacttaactgaaaaataatattccaaattcttaatgtaacatgaaaagagaaatacaatttttgcttaaaagacattttttaaaaagcgttcaattcagtaatcatttctgttaatacaggaagtttttttggcttgccagttatatactgtgggtattttttaaaatgtgctacccttgggttgtctcatatcaccttgcgtaatcatgtattacaaaggttgataattgtcatttctcagatgtctgtatgttacattggcagcagtaaaatgttttaatgttgttaccttttaaataattgtgttgtattaacatgcctcatattttctggggaaacttgaaatatatctaaacaaaaaaggtctgttataaataggaattggcatttcattgttaatgttttttcctcataaaaatagttacaccaaaagtgacatattgtctattacatgggcccaatcagtattaaagtactccccttactcaaaaatattaaaaaataattcatgacacttagtagcattttcattgattgtttcaaaagatcttcataatggtcaaattgtccaattcacaaaagagtgagaaagttgttttcagtactgggaatttttaaaccttagttttaagaccaaaaatatctcttattagcttgaacattttgtgattacttttccctccccggatctagtccttttaaggagtaagtctaaagaatgaggccatgaagtcactatttcctcccacctcagtttgtctcctggtacttagctggcctatcgctttgtgtggcaatacccctgggtcgcttccccactcagccttctgtatctgctgttcacaggacatgccattatgtctttccagtacggatcacagtgctgccatatcacagaccctgccagccggcacagaaccatgcctcgtcacagctctgcccaactcacaggctgccaagatgaggccacaggtccacctagggcggcagatgctggtgctatttgtcacgacttttgccaaaacatgtacactgttgctcacatctttcgtaagaatggttgacactaaggggccatggaaaagcacttttaaaaaattatgtggtggaatcaaactcacagaggcagaaatgttagtgccgtgctctaaccaagtaagcttagtgttccccacagtgatctgtatctggcctgagtctcctcaagcagcaacccccactgtccagcatgtggaaggtagatccttatgacaacaccagacccatagttaccaggaaagaaaaaggaagctgagtgttgtgaaggggaagaaatcctttttataagaagtaatcatttttaggccgggtgcagtggctcatgcctgtaatcccagcactttgggaggctgagacaggtggatcacttgaggtcaggagtttgagacctgcctggccaacatgatgaaaccctgtctctactaaaaatgcaaaaaaaattagccaggcatggtggcatgtgcctgtagtcccaactactcaggaggctgaggcaggagaatcacttgaacctgggaggcagaggttgcaatgagctgagatcgcaacactgcactccagcctgggcgacagagcaagactccatctcaaaaacaaaaacaaaaaaaaaacctttttaaagtaaattgagtgtaaaatgttttcaccatgaagccattgcaccctctcccccaggaaacagtgcctaaggatgatgtcaagttacagccagtttgctctgatcccccaggacctaagaaaactgtgagtgcttcagcatgcaaaggtagagctaccagataaggagaataacttggccatttatagcaaactgcctgactttggagtgagaaaccaagcaccttctaggtcctaggataggtgaattggaggtgcagctgctgaagttcccattttctacatacttcaggagccagggtgtttcatttggttttgtaaaactttgctgtaagtcatcacagttaattctttgaatggacattttagagtgtaactttttttcaaaattagcagaacagatatctctgctcattctctttatacatttagttttttaaagttcccctagtatacctgttaggcactctaaataggacacagttaaagctaaaagaaggaccagttgctccctagagcctacagttcagaactatcttgttgtcatgtcctggtttggtttggtttgtttttaactcaacaagttggaaaccatgagtttaaagcaaactatttccttttcttaagcttaaagagaattttttttttaatctttagctcctcatttaggtagtgaaggcttccctgaaagacagcagtgcccttctctggaagaagaggctgggaccaaaagcctgagtctatgggttgaggattttgagcattcctttgacaagcttctatgtatttttaatataagactcataaatgaacctgatgtggtgttcatgacccatcccttaagcatgcttgctttttttaactttactttttgagtatagtacttgtcttgtttttcctggagccatgctaggatttaattcctatgtgccactacccgcccatgtcctggaagatggccatgcctgcagcaatgctcatgtcttgaggagaagcaatgtgaaaagcatcaggaaagctgaaccttacgttcaagtcagcaaacatttgtgagcattctagtatgcttgcgaccttgacactttttaaaaattatctttttatttgcttcgagtatcaaccgtatagttgactctagtggggcgaagggagcagagatgagagcaaaattcagacttgctgcccctgtgtgtctcagttctcatgtctctctgagaaatgtgttggcccaattccctatctgccactctgagtctcttgagtaaatgtgtgtaaatgagaaaaattatctcaaagatttaacttattatttagatattttcttctttttaaactcaggaataaacctggtttgtagataatataatatggctactagagctataattgagtaggtgactagaagcattttttcaaatatatttcttgtaaagacatctactttgttttaactaggaaaagaaactcctcatattaaaataaacatttccataagcactttctagaagagtgtagcatccatctaccatccatcccagaatgtttgtatcttgctcatagtatttcaaaaatttttatgggtgaaaaaaatgcacttttttatttattggaaaagtgtagagttattgaattaaattctcaagtgggacaatttagtgtaaagggaaacatgggttttggagacaagagcacagggctgtggtccctgttccagcattgactttactatgtgacctcgagcaaatgatttaacttctctgtgcctcagtttctccatatacaaaatggggataatgatactaaccattgcctacctcatagagatgttatggggacaaacgaaataatagagataagcacgaatgctttcaactcttcggaagaaaggtgctatataaattgaagttgtgtttttaatgatccaattattaattatgtttagggtttaaataacaatactgttagtcatgttaagaataagttttgttttgatgcatatttccacttctcttctgtggccagatcttgatcattcaaccagtaatggtacctgaggaactgaaatgggtatttgttttcgtatgtttctgccagtagtatttcaattgaatatccagaaaagactggagtttaacttgtaatatcttatagtttacatgtaataaaacttattcaagctatatataaaagtatgattacatgtaaatagcaggtatgttgtaattaaaggcacttatcaaattgtctttgttcttttttaattgtaataaaagtcagttttacataaaaaaaaaaaaaaaaaa

SEQ ID NO: 18 - DNA, 6264 bp, Homo sapiens
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagcccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacgggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccgggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccgggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggcccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggggtgacaaaggtgccccagggagagcaggcctgtatggcgagattggcgcgactggtgatttcggtgacatcggggacactataaatttaccaggaagaccaggcctgaagggggagcggggcaccactggaataccaggtctgaagggattctttggagagaagggaacagaaggtgacatcggcttccctgggataacaggcgtgactggagtccaaggccctcctggacttaaaggacaaacaggctttccagggctgactgggcctccagggtcgcagggagagctggggcggattggactgcctggtggcaaaggagatgatggctggccgggagctccgggcttaccaggttttccgggactccgtgggatccgcggcttacacggcttgccaggcaccaagggctttccaggatccccaggttctgacatccacggagacccaggcttcccaggccctcctggggaaagaggtgacccaggagaggccaacacccttccaggccctgtgggagtcccaggacagaaaggagaccaaggagctccaggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccaccggggcggtgggcgacagaggccccaagggacccaagggagacccaggattccctggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccagtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcagggcctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaa

SEQ ID NO: 19 - DNA, 1059 bp, Homo sapiens
agcaagatggatctactgtggatcctgccctccctgtggcttctcctgcttggggggcctgcctgcctgaagacccaggaacaccccagctgcccaggacccagggaactggaagccagcaaagttgtcctcctgcccagttgtcccggagctccaggaagtcctggggagaagggagccccaggtcctcaagggccacctggaccaccaggcaagatgggccccaagggtgagccaggagatccagtgaacctgctccggtgccaggaaggccccagaaactgccgggagctgttgagccagggcgccaccttgagcggctggtaccatctgtgcctacctgagggcagggccctcccagtcttttgtgacatggacaccgaggggggcggctggctggtgtttcagaggcgccaggatggttctgtggatttcttccgctcttggtcctcctacagagcaggttttgggaaccaagagtctgaattctggctgggaaatgagaatttgcaccagcttactctccagggtaactgggagctgcgggtagagctggaagactttaatggtaaccgtactttcgcccactatgcgaccttccgcctcctcggtgaggtagaccactaccagctggcactgggcaagttctcagagggcactgcaggggattccctgagcctccacagtgggaggccctttaccacctatgacgctgaccacgattcaagcaacagcaactgtgcagtgattgtccacggtgcctggtggtatgcatcctgttaccgatcaaatctcaatggtcgctatgcagtgtctgaggctgccgcccacaaatatggcattgactgggcctcaggccgtggtgtgggccacccctaccgcagggttcggatgatgcttcgatagggcactctggcagccagtgcccttatctctcctgtacagcttccggatcgtcagccaccttgcctttgccaaccacctctgcttgcctgtccacatttaaaaataaaatcattttagccctttcaaaaaaaaaaaaaaaaaaaaaaaaaaaaa

SEQ ID NO: 20 - DNA, 4919 bp, Homo sapiens
agaagtttgcagagcgctttctcgccggctggtcccggactcgcgctgcgccctgcgccctgcgccgccgcctcctccttctgccgccgccgccctgttctcccgggattccttctctgtggaggactgactctctgcttgtgggaattagaggtggacaagggggagtgccggggggtagcgacggggttctttccagtggcagctgcgagtcgggacgccgggagcgtggggctcctgctggccacggatctcggccaccttcccgcggcctccgggcaggcaatgcggccgccgagccccgcgacgcagagaggaaggagggtggcccggagggcctagagcttgtttctgcccacttgggaaagagggcatggagttgtgagtgcccctcgctcggcgacgccgccctcggcaggctccccatggccgggacgtacagctcgactctgaagacgctggaggacttgaccttggactccgggtatggggccggggactcgtgccgctcgctcagcctctcgtcctccaagtccaactcgcaggcgctcaactcttcggcgcagcagcaccgcggggcggcctggtggtgctactccggctccatgaacagccgccacaacagctgggacacggtgaacacggtgctgcccgaggaccccgaagtggccgacctcttctcgcgctgtccgcggctccccgagctggaggagttcccctggaccgaaggagacgtggcccgggtgctccgcaaaggcgctggcggccggcggctgccccagttctccgccgaggcggtgaggcgcctggccgggctgctccgcagggcactgatccgcgtggcccgcgaggcgcagcgcctgagcgtgctgcacgccaagtgcacccgctttgaggtgcagagcgccgtgcgcctggtgcacagctgggcgctggccgagagctgcgcgctggcagccgtcaaggcgctgtccctgtacagcatgagcgccggcgacgggctgcgccggggcaagtccgcgcgctgcggcctcaccttctcagtgggtcgctttttccgctggatggtggacacccgaatctccgtgcgcatccacgagtacgcagccatctccctcaccgcctgcatggagaacctggtggaggagatccgggccagggtgatggccagccacagccctgatggcggaggggccggaggcggggaggtgtctgctgaggccctggagatggtcatcaacaacgacgccgagctctggggcgtcttgcagccctatgagcatctcatctgcggcaagaacgccaatggtgtcctctccctccccgcatacttcagcccctacaacggcgggtccctgggccatgacgagcgagccgatgcctatgcccagctggagctccgaaccctggagcagtccctcctggccacctgcgtgggcagcatctcggagctgagtgacttggtctcccgtgccatgcaccacatgcaggggcgtcaccccctgtgcccgggtgccagccctgcccgccaggcccgccagccgccacagcccatcacttggtcccccgacgccctccacacgctctactactttctgcggtgtccacagatggagtccatggagaaccccaacctggaccccccgagaatgaccttgaacaatgaacggcccttcatgctgctgccgcccctcatggagtggatgcgcgtggccatcacctacgcagagcaccgccgcagcctcaccgtggacagcggcgacatccggcaggcagcccggctgctgctgcctggtctggactgtgaacctcggcagctcaaacccgaacactgtttcagttccttccggaggctggatgcccgagcagctactgaaaaattcaaccaggacctgggtttccgcatgctcaactgtgggaggacggacctcatcaaccaagccatcgaggccttgggtccggatggggttaacaccatggatgaccagggtatgacgccactgatgtacgcctgcgctgctggggacgaagcgatggtccagatgttgattgatgctggggcaaacttggacatccaggttccaagcaactcccccaggcacccttccatccaccccgacagccggcactggacctcactgacattcgctgtgctgcatggacacatctctgtggtccagttgctgctggatgctggtgcccatgtcgagggctcggcagtgaacggcggcgaggacagctatgcggagacgcccctgcagctggcctctgcggcagggaactatgagctggtcagtttgttgctgagccgaggcgccgaccccctcctcagcatgctggaggcccacggcatgggctcctccctccacgaggacatgaactgcttcagccactcagctgcccacggccacaggaacgtcctgaggaagctcctgacgcagccacagcaggctaaagcggacgtgctgtccctggaggagatcctggccgagggtgtggaggaaagtgatgcgtcgagccagggcagtggcagcgaggggcccgtgcggctgagccggacccgcaccaaggccctacaggaggccatgtactacagcgctgagcacggctacgtggacatcaccatggagctgagggcactgggagtcccctggaagctgcacatctggatcgagtctctgaggacctcgttctcgcagtcgcggtactcggtggtgcagagcctcctgcgggacttcagctccatcagagaggaggagtacaacgaggagctggtgaccgagggcttgcagctcatgttcgacatcctcaagaccagcaaaaacgactccgtcatccagcaactggctaccatcttcacccactgctatggcagcagtcccatccccagcatcccagagatccggaagaccctgccggccaggctagatccacactttttgaacaataaggagatgtcagatgtgaccttcctggtggaaggaaagctgttttatgcacataaagtcctgctggtgacagcttctaacaggttcaagacactaatgaccaataaatcagaacaggatggggacagcagcaagaccatcgagatcagcgacatgaagtaccacatttttcagatgatgatgcagtatctgtactacggaggaacagaatccatggagatccccaccactgacatcctggagctgctgtcagctgccagcctgttccagctggatgccctgcagaggcactgcgagatcctgtgctcccagaccctcagcatggagagtgccgtgaacacctacaaatatgccaagatccacaatgccccagaactggccctgttctgtgagggcttcttcctcaagcacatgaaggccctactggagcaggatgccttccggcagctcatctacggccgcagcagcaaagtgcagggcctggatccactgcaggacctgcagaacaccctggcagagcgcgtgcactctgtctacatcacctcccgggtgtgaggcagggggcggaggctgccgaggccagggcctgtggaggtgccagggcccaccatgtcggggtatggttgtaggccctcttggagccaggttcacggggctgtttcctcctcctcccccagatgtcccccctgtcaccgggcagctcaccctcatctcctctgccctagagctgtttgttcaatcactgatgggcaaaggggagatgtagctaactggtggccctcctccccatctcagtttgcaactcaagggcagccatgcactcccccggggtgtcgctctcccctcctgcaggtcagcagctgatcctgatccacctccgcccaggccctccaagctctactcacccctagggcctcagtaaactcagaccatcccaactggggctcctgggggtacaggaatccttatgaatgtatagaatgcatactgcctaggcccccagtcgtctgcagtaattcaaaagctggtatttttcttcctaaatgtcacatagcaaaggctgcccaaatccccaaacttgttcttcaaaggtttgacaggcttaatgtgggcatccagtggcctgtggacccccccctgccaccacgactgctgccacccggagttcccccattgtctttggtgcctgggcttccagagtccctcccatcaggactaccagcttgctcagttagcagcagagggcagttccccagcttgatggtttctgagctaagtctggcatggaggggcaaggggtaggggatggggtgctgtgtaggaatggcctcagctcttgttttgctgctggttttaggggccaaagtaaatgggtggattctggaacctcaggcctagactaggttgcctttgtgggggcgatgaagcagagtcccctggtcaagtctctcggctcctttaatgtaggattgagagctgggcaaacaggtcccactggggactgtgactcttggagattaaaggacagggcattgatggaaggtaagggccaggagaagaggcctttctgctgtgtcccctcacggccttgccctcgaattctgcaggccctgggctcccctgacacctgtcatatttatggaccagacactggggcagcatcaggcacagtctgtctgggtgcaacttcttcagctgtctggccgcaccttaaaaactatttattcaccaaaagccccaggcatttcagaaggtggcactcaggtcaccctgaaaagcccccaggggcttgcaattctggaaaatattttgactagctgcttggctggatgtacaaagaaataggcattattttattgctgtaatattgtatgatactttaactgtacaataatgttgtcacttactgtaaatgtactatggttttattaacaataaacactcattaacaatgaaaaaaaaaaaaaaaaa

SEQ ID NO: 21 - DNA, 3098 bp, Homo sapiens
gcacgcagccttagctccttccccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttctgtaatactgtgtgacctgtggttgttgtaatggtgatcatggagagcaaatatgaacttggcctggattttaaatggcctagaatttgtggtagttgccaaagaggttctcctaggtggtcttaataaacctattcacagaattctccttaaaaaaaaaaaaaaaaaaaa

SEQ ID NO: 22 - DNA, 4263 bp, Homo sapiens
aggaaacggtttattaggagggagtggtggagctgggccaggcaggaagacgctggaataagaaacatttttgctccagcccccatcccagtcccgggaggctgccgcgccagctgcgccgagcgagcccctccccggctccagcccggtccggggccgcgcccggaccccagcccgccgtccagcgctggcggtgcaactgcggccgcgcggtggaggggaggtggccccggtccgccgaaggctagcgccccgccacccgcagagcgggcccagagggaccatgaccttgggctcccccaggaaaggccttctgatgctgctgatggccttggtgacccagggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctggaggccacccaacctccttcggagcagccgggaacagatggccagctggccctgatcctgggccccgtgctggccttgctggccctggtggccctgggtgtcctgggcctgtggcatgtccgacggaggcaggagaagcagcgtggcctgcacagcgagctgggagagtccagtctcatcctgaaagcatctgagcagggcgacagcatgttgggggacctcctggacagtgactgcaccacagggagtggctcagggctccccttcctggtgcagaggacagtggcacggcaggttgccttggtggagtgtgtgggaaaaggccgctatggcgaagtgtggcggggcttgtggcacggtgagagtgtggccgtcaagatcttctcctcgagggatgaacagtcctggttccgggagactgagatctataacacagtgttgctcagacacgacaacatcctaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgcagtgttgcatcgccgacctgggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggtcctctcaggcctagctcagatgatgcgggagtgctggtacccaaacccctctgcccgactcaccgcgctgcggatcaagaagacactacaaaaaattagcaacagtccagagaagcctaaagtgattcaatagcccaggagcacctgattcctttctgcctgcagggggctgggggggtggggggcagtggatggtgccctatctgggtagaggtagtgtgagtgtggtgtgtgctggggatgggcagctgcgcctgcctgctcggcccccagcccacccagccaaaaatacagctgggctgaaacctgatcccctgctgtctggcctgctcaaagcggcaggctccctgacgcctggctctctccccacccctatggccagcatggtgcaccccctaccactcccgggacaggatgcaaaagaggctccagagtcagagtgccaagccagggaatcccagtcccagactcagagcccgggcctgcactttgccccctgcccttgatcaaccccactgccccaccagagctgccagggtggcacagggccctgtccagcccctggcacacacttccctgccaggcctcagcctctagcataagctccagagagccagggcccatcagtttctctctgtggatttgtatctcagctccatgatgccttgggctttctgtctcctcaacaagagtgcagcttgctgaatgtcagctgcctgagagagctggggcctgacttactagggcattaaatcctaagaggtcctactgaggtgtggcaggatcacaggccagtggaaaaagggcaggtcagatgggcaaggcccaggactttcagattaactgagaggatatcgaggccaagcatggcagggggaaggtcagtgggtgtcaagagacccaggtctgaccccggatgtttgctccatgtgacaaaagcaggcctgtctcaggaccttttcttttcttttttccttctttttttttttgacacggagtttcgctcttgttgtccaggctagagtgcaatggcatgatcccagctcaccgcaacgtctacctcccaggttcaaatcattctcttgcctcagactcccgagtagctgggattacaggcacatgccaccatgcctggctaattttgtatatttagtagaaacagggtttcaccatgctggccatgctggtctcgaactcctgacctcaggtgttccacctacctcagcctcccaaagtgctggggttacaggtgtgagccatcgcgcctggccaggacctttgtttcttatctacatattggaagatttggtcctgatgtcctttgaggcttctttagctctagttctctgacacttcagcctatatcacagctaacttcttcagtctcatctattccttatgctccagcccctggcaatttgcctcaagatgggggtttgaaaataactttacctgactcaaggagtgtctggagcacctcctagtctaagtctgcaagctccagttcttgcctaaaaccatgccagtggccacccttgggctcagacagctctgggccttttgaccacaagccagcccctcgccctctctgtggcatagtcttctctgccccaggactgcagggcggcttcctccaaggcttccaaggctcaaaagaaatttggctccatccaagaaggctccagctcccctactggcccctggctcaggcccacacccctggccaggcccagagagtgtgtctcaggagaattcaatggctctagagagacacacagaaagtttggcatttggaaatttcaaggatgtatgtatgctcacgtatggagcaggttgtcctggtccctgggtgcagggaagtgggctgcagggaagtggattggaggggagcttgaggaatataaggagcgggggtggagactcaggctatggacaaggacagccccaaggttgggaagacctggccttagtcgtcctcagcctaggggcagggcagtgaagaaagctctccccgctcctgctgtaatgacccagagtagcctccccaggccggcatcttatgtgtgtcttccaccatcctcatggtggcacttttctaggcctgtctcccagcattgtgcaaggctcggaagagaaccaggaagtgaaactgggtgaaaacagaaagctcaatggatgggctaggttcccagatcattagggcagagtttgcacgtcctctggtcactggaatccacccagcccacgaatcatctccctcttgaaggattttatttctactgggttttggaacaaactcctgctgagaccccacagccagaaactgaaagcagcagctccccaaagcctggaaaatccctaagagaaggcctggggcaggaagtggagtgacaggggacaggtagagagaagggggcccaatggccagggagtgaaggaggtggcgttgctgagagcagtctgcacatgcttctgtctgagtgcaggaaggtgttccagggtcgaaattacacttctcgtacctggagacgctgtttgtgggagcactgggctcatgcctggcacacaataggtctgcaataaaccatggttaaatcctga

SEQ ID NO: 23 - DNA, 5591 bp, Homo sapiens
gctactcccaccccgccccgccccgtcattgtccccgtcggtctcttttctcttccgtcctaaaagctctgcgagccgctcccttctcccggtgccccgcgtctgtccatcctcagtgggtcagacgagcaggatggagggctgcatgggggaggagtcgtttcagatgtgggagctcaatcggcgcctggaggcctacctggcccgggtcaaggcgctggaggagcagaatgagctgctcagcgcggagctcggggggctccgggcacaatccgcggacacctcctggcgggcgcatgccgacgacgagctggcggccctgcgggccctcgttgaccaacgctggcgggagaagcacgcggccgaggtggcgcgcgacaacctggctgaagagctggagggcgtggcaggccgatgccagcagctgcggctggcccgggagcggacgacggaggaggtagcccgcaaccggcgcgccgtcgaggcagagaaatgcgcccgggcctggctgagtagccaggtggcagagctggagcgcgagctagaggctctacgcgtggcgcacgaggaggagcgcgtcggcctgaacgcgcaggctgcctgtgccccccgctgccccgcgccgccccgcgggcctcccgcgccggccccggaggtagaggagctggcaaggcgactgggcgaggcgtggcgcggggcagtgcgcggctaccaggagcgcgtggcacacatggagacgtcgctgggccaggcccgcgagcggctgggccgggcggtgcagggtgcccgcgagggccgcctggagctgcagcagctccaggctgagcgcggaggcctcctggagcgcagggcagcgttggaacagaggttggagggccgctggcaggagcggctgcgggctactgaaaagttccagctggctgtggaggccctggagcaggagaaacagggcctacagagccagatcgctcaggtcctggaaggtcggcagcagctggcgcacctcaagatgtccctcagcctggaggtggccacgtacaggaccctcctggaggctgagaactcccggctgcaaacacctggcggtggctccaagacttccctcagctttcaggaccccaagctggagctgcaattccctaggaccccagagggccggcgtcttggatctttgctcccagtcctgagcccaacttccctcccctcacccttgcctgctacccttgagacacctgtgccagcctttcttaagaaccaagaattcctccaggcccgtacccctaccttggccagcacccccatcccccccacacctcaggcaccctctcctgctgtagatgcagagatcagagcccaggatgctcctctctctctgctccagacacagggtgggaggaaacaggctccagagcccctgcgggctgaagccagggtggccattcctgccagcgtcctgcctggaccagaggagcctgggggccagcggcaagaggccagtacaggccagtccccagaggaccatgcctccttggcaccacccctcagccctgaccactccagtttagaggctaaggatggagaatccggtgggtctagagtgttcagcatatgccgaggggaaggtgaagggcaaatctgggggttggtagagaaagaaacagccatagagggcaaagtggtaagcagcttgcagcaggaaatatgggaagaagaggatctaaacaggaaggaaatccaggactcccaggttcctttggaaaaagaaaccctgaagtctctgggagaggagattcaagagtcactgaagactctggaaaaccagagccatgagacactagaaagggagaatcaagaatgtccgaggtctttagaagaagacttagaaacactaaaaagtctagaaaaggaaaataaagagctattaaaggatgtggaggtagtgagacctctagaaaaagaggctgtaggccaacttaagcctacaggaaaagaggacacacagacattgcaatccctgcaaaaggagaatcaagaactaatgaaatctcttgaaggtaatctagagacatttttatttccaggaacggaaaatcaagaattagtaagttctctgcaagagaacttagagtcattgacagctctggaaaaggagaatcaagagccactgagatctccagaagtaggggatgaggaggcactgagacctctgacaaaggagaatcaggaacccctgaggtctcttgaagatgagaacaaagaggcctttagatctctagaaaaagagaaccaggagccactgaagactctagaagaagaggaccagagtattgtgagacctctagaaacagagaatcacaaatcactgaggtctttagaagaacaggaccaagagacattgagaactcttgaaaaagagactcaacagcgacggaggtctctaggggaacaggatcagatgacattaagacccccagaaaaagtggatctagaaccactgaagtctcttgaccaggagatagctagacctcttgaaaatgagaatcaagagttcttaaagtcactcaaagaagagagcgtagaggcagtaaaatctttagaaacagagatcctagaatcactgaagtctgcgggacaagagaacctggaaacactgaaatctccagaaactcaagcaccactgtggactccagaagaaataaatcagggggcaatgaatcctctagaaaaggaaattcaagaaccactggagtctgtggaagtgaaccaagagacattcagactcctggaagaggagaatcaggaatcattgagatctctgggagcatggaacctggagaatttgagatctccagaggaggtagacaaggaaagtcaaaggaatctggaagaggaagagaacctgggaaagggagagtaccaagagtcactgaggtctctggaggaggagggacaggagctgccgcagtctgcagatgtgcagaggtgggaagatacggtggagaaggaccaagaactggctcaggaaagccctcctgggatggctggagtggaaaatgaggatgaggcagagctgaatctgagggagcaggatggcttcactgggaaggaggaggtggtagagcagggagagctgaatgccacagaggaggtctggatcccaggcgaggggcacccagagagccctgagcccaaagagcagagaggcctggttgagggagccagtgtgaagggaggggctgagggcctccaggaccctgaagggcaatcacaacaggtgggggccccaggcctccaggctccccaggggctgccagaggcgatagagcccctggtggaagatgatgtggccccagggggtgaccaagcctccccagaggtcatgttggggtcagagcctgccatgggtgagtctgctgcgggagctgagccaggcccggggcagggggtgggagggctgggggacccaggccatctgaccagggaagaggtgatggaaccacccctggaagaggagagtttggaggcaaagagggttcagggcttggaagggcctagaaaggacctagaggaggcaggtggtctggggacagagttctccgagctgcctgggaagagcagagacccttgggagcctcccagggagggtagggaggagtcagaggctgaggcccccaggggagcagaggaggcgttccctgctgagaccctgggccacactggaagtgatgccccttcaccttggcctctggggtcagaggaagctgaggaggatgtaccaccagtgctggtctcccccagcccaacgtacaccccgatcctggaagatgcccctgggcctcagcctcaggctgaagggagtcaggaggctagctggggggtgcaggggagggctgaagccctggggaaagtagagagcgagcaggaggagttgggttctggggagatccccgagggcccccaggaggaaggggaggagagcagagaagagagcgaggaggatgagctcggggagacccttccagactccactcccctgggcttctacctcaggtcccccacctcccccaggtgggaccccactggagagcagaggccaccccctcaaggggagactggaaaggagggctgggatcctgctgtcctggcttccgagggccttgaggccccaccctcagaaaaggaggagggggaggagggagaagaggagtgtggccgtgactctgacctgtcagaagaatttgaggacctggggactgaggcaccttttcttcctggggtccctggggaggtggcagaacctctgggccaggtgccccagctgctactggatcctgcagcctgggatcgagatggggagtccgatgggtttgcagatgaggaagaaagtggggaggagggagaggaggatcaggaggaggggagggagccaggggctgggcggtgggggccagggtcttctgttggcagcctccaggccctgagtagctcccagagaggggaattcctggagtctgattctgtgagtgtcagtgtcccctgggatgacagcttgaggggtgcagtggctggtgcccccaagactgccctggaaacggagtcccaggacagtgctgagccttctggctcagaggaagagtctgaccctgtttccttggagagggaggacaaagtccctggccctctagagatccccagtgggatggaggatgcaggcccaggggcagacatcattggtgttaatggccagggtcccaacttggaggggaagtcacagcatgtgaatgggggagtgatgaacgggctggagcagtctgaggaagtggggcaaggaatgccgctagtctctgagggagaccgagggagcccctttcaggaggaggaggggagtgctctgaagacctcttgggcaggggctcctgttcacctgggccagggtcagttcctgaagttcactcagagggaaggagatagagagtcctggtcctcaggggaggactaggaaaagaccatctgcccggcactggggacttaggggtgcggggaggggaaggacgcctccaagcccgctccctgctcaggagcagcactcttaacttacgatctcttgacatatggtttctggctgagaggcctggcccgctaaggtgaaaaggggtgtggcaaaggagcctactccaagaatggaggctgtaggaatataacctcccaccctgcaaagggaatctcttgcctgctccatctcataggctaagtcagctgaatcccgatagtactaggtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtccctgcctgaataaagtaatgcctccgcttcaaaaaaaaaaaaaaaaaaaaaaaaaaaaaaaaaaaa

SEQ ID NO: 24 - DNA, 11457 bp, Homo sapiens
cgccgccgccgccgccaccgcgggagccagagctgccgggaggagcggcatccgcgccagactggagcgggagggcggcggagggcagttgctgggaatttttcagccgagagggcgagcgatccggagagagaccccgagagcttgggagcggtagggcgtgcgagcgccgcagccagcggagcaaacctcgaaatagatctggaaagccaggctcccggaggaaatgggactgtgaacgaaccggagagcaagaagggaaggaagcgccgggattgctgatgtcagaggagcccggaaagtcgcgctggaaaaatctgaagacagccggggctctgcttcttcctcaggagagacaccgccggccgcccccacacgccccctcggcgcctccgggtgccccctgagagccggcgacagcgcccagccgggctgctgcggggcgacggaggactgaggggcgcgcggagcggagaccgaggagcgacttcaggaatacagataagtgtctggtggcttgacgtggattttaatgaatttggactccatgtggatttggtcgtctccctgattccgagctgcgggcagggagaggggcctcgcgccgccctcagcagccggcggcggccgaggtagaccgagcggggacggaaggacagaccgacgtcgccgagctggaatcatgtgagggccaaccggggaaggtggagcagatgagcacacacaggagccgtctcctcaccgccgcccctctcagcatggaacagaggcggccctggccccgggccctggaggtggacagccgctctgtggtcctgctctcagtggtctgggtgctgctggcccccccagcagccggcatgcctcagttcagcaccttccactctgagaatcgtgactggaccttcaaccacttgaccgtccaccaagggacgggggccgtctatgtgggggccatcaaccgggtctataagctgacaggcaacctgaccatccaggtggctcataagacagggccagaagaggacaacaagtcttgttacccgcccctcatcgtgcagccctgcagcgaagtgctcaccctcaccaacaatgtcaacaagctgctcatcattgactactctgagaaccgcctgctggcctgtgggagcctctaccagggggtctgcaagctgctgcggctggatgacctcttcatcctggtggagccatcccacaagaaggagcactacctgtccagtgtcaacaagacgggcaccatgtacggggtgattgtgcgctctgagggtgaggatggcaagctcttcatcggcacggctgtggatgggaagcaggattacttcccgaccctgtccagccggaagctgccccgagaccctgagtcctcagccatgctcgactatgagctacacagcgattttgtctcctctctcatcaagatcccttcagacaccctggccctggtctcccactttgacatcttctacatctacggctttgctagtgggggctttgtctactttctcactgtccagcccgagacccctgagggtgtggccatcaactccgctggagacctcttctacacctcacgcatcgtgcggctctgcaaggatgaccccaagttccactcatacgtgtccctgcccttcggctgcacccgggccggggtggaataccgcctcctgcaggctgcttacctggccaagcctggggactcactggcccaggccttcaatatcaccagccaggacgatgtactctttgccatcttctccaaagggcagaagcagtatcaccacccgcccgatgactctgccctgtgtgccttccctatccgggccatcaacttgcagatcaaggagcgcctgcagtcctgctaccagggcgagggcaacctggagctcaactggctgctggggaaggacgtccagtgcaccaaggcgcctgtccccatcgatgataacttctgtggactggacatcaaccagcccctgggaggctcaactccagtggagggcctgaccctgtacaccaccagcagggaccgcatgacctctgtggcctcctacgtttacaacggctacagcgtggtttttgtggggactaagagtggcaagctgaaaaagattcgggccgacggtcccccccatggtggggtccagtacgagatggtctctgtgctcaaggacggaagccccatcctccgggacatggccttctccattgatcagcgctacctgtacgtcatgtctgagagacaggtcaccagggtccccgtggagtcatgtgagcagtatacgacttgtggggagtgcctgagctctggggaccctcactgtggctggtgtgccctgcacaacatgtgctcccgcagggacaaatgccaacaggcctgggaacctaatcgatttgctgccagcatcagccagtgtgtgagccttgcagtgcatcccagcagcatctcagtatctgagcacagccggttgcttagcctggtagtgagtgatgctcctgatctatctgcgggtatcgcctgtgcctttgggaacctgacagaggtggaggggcaggtgtccgggagccaggtcatctgcatctcacctgggcccaaggatgtccctgtcatcccgctggatcaagactggtttgggctggagctacagctgaggtccaaggagacagggaagatatttgtcagcaccgagttcaagttttacaactgcagtgcccaccaactgtgcctgtcctgtgtcaacagcgccttccgctgccattggtgcaagtaccgcaacctctgcactcatgaccccaccacctgctccttccaggagggccggatcaatatttcagaggactgtccccagctggtgcccacagaggagatcttgattccagtcggggaggtaaagccaatcacccttaaggcgcgaaatctgccccagccgcagtccggccagcgaggctatgagtgtgtcctcaacatacaaggagccatccaccgggtccccgctctgcgcttcaacagctccagcgttcagtgtcagaacagctcgtaccagtatgatggcatggacatcagcaatctggccgtggatttcgctgtggtgtggaacggcaatttcatcattgacaaccctcaggacctgaaagtccatctctacaagtgtgcagcccagcgggagagctgcggcctctgcctcaaggccgaccggaagtttgagtgtggctggtgcagcggcgagcgcaggtgcaccctccaccagcactgtaccagcccttccagcccctggctcgactggtccagccacaatgtcaagtgctccaaccctcaaatcaccgagattttgacggtgtctggaccgccggaaggagggacgcgagtgaccatccatggcgtgaacctgggtctggacttctccgagatcgcccaccatgtgcaggtggctggggtgccctgcacgcccctcccaggggaatacatcatcgctgagcagattgtctgtgagatgggccatgccctcgtgggaaccacctccgggccagtacgcctgtgtattggcgagtgtaagccagagttcatgacgaagtcccatcagcagtacaccttcgtgaacccttctgtgctgtcactcaacccaatccgaggtcccgagtcaggaggcactatggtgaccattaccggccattaccttggggctgggagcagcgtggcagtctacctgggcaaccagacctgcgagttctacgggaggtcaatgagtgagatcgtgtgtgtctcacccccatcatccaatggccttggcccggtccctgtttctgtgagtgtcgaccgagcccatgtggatagcaacctgcagtttgagtacatagatgaccctcgggtccagcgcatcgagccagagtggagcattgccagtggccacacacccctgaccatcacaggcttcaacctggatgtcattcaggagccaaggatccgagtcaaattcaatggcaaagaatctgtcaatgtgtgtaaagttgtgaacacaaccaccctcacctgcctggcaccctctctgaccacggactaccgccctggcctggacactgtggaacgcccagatgagtttggatttgtctttaacaatgtccaatccttgctaatttacaacgacaccaagtttatctactaccccaacccgacctttgaactgcttagccctactggagtcttggatcaaaagccaggatcgcccatcattctgaagggcaaaaacctctgccctcctgcctctggaggggccaaactcaactacactgtgctcatcggagagaccccttgtgctgtcaccgtatctgagacccagcttctctgcgagcctcccaacctcaccgggcagcacaaggtcatggttcacgtgggcgggatggtgttctcgcctggctcggtgagtgtcatctcagacagcttgctgaccctgccagccatcgtcagcatcgcggccggcggcagcctcctcctcatcatcgtcatcatcgtcctcattgcctacaagcgcaagtctcgagaaaatgacctcactctcaagcggctgcaaatgcagatggacaatctggagtcccgtgtggccttggagtgcaaggaagcttttgctgagctccagacggatatcaatgagttgaccagtgacctggaccgctcaggaatcccttacctggactatcgtacctacgctatgcgagtcctgttcccgggcatcgaggaccaccccgtcctgcgggagctggaggtacaaggaaacgggcagcagcacgtggagaaggccctgaagctctttgcccagctcatcaacaacaaggtgttcctgctgaccttcatccgcaccctggagctgcagcgcagtttctccatgcgcgaccggggcaacgtggcttcgctcatcatgaccggcctgcagggccgcctggaatatgccactgatgtcctcaagcagctgctctctgacctcatcgataagaacctggagaacaagaaccaccccaagctgctactccggaggacagagtctgtggctgaaaagatgctgaccaattggttcgccttcctcctgcacaagttcctaaaggagtgcgcaggggagccactcttcatgctatactgtgccatcaagcagcagatggagaagggccccattgatgccatcacgggcgaggcccgctactccctgagcgaggacaagctcatccggcagcagatcgagtacaagaccctgatcctgaactgcgtcaaccctgacaacgagaacagtccagagatcccagtgaaggtgttaaactgtgacaccatcacacaggtcaaggagaagattcttgatgccgtgtataagaatgtgccctattcccagcggccgagggcagtggacatggacttggagtggcgccaaggccggatcgcccgggtcgtgctgcaagatgaggacatcaccaccaagattgagggtgactggaagcggctcaacacactgatgcattatcaggtgtcagacaggtcggtggtggctctggtccccaaacagacctcctcctacaacatccctgcctctgccagcatctcccggacgtccatcagcagatacgactcctccttcaggtatacgggcagccccgacagcctgcggtcccgggccccgatgatcaccccagacctggaaagtggggtcaaggtgtggcatctggtgaagaaccatgaccacggtgaccagaaggagggtgaccggggcagcaagatggtgtccgagatctacctgacccggctactggccaccaagggcaccctgcagaagtttgtggacgacttgtttgagaccttgttcagcactgtgcaccggggcagcgctctccccctggccatcaagtacatgtttgatttcctagatgagcaggcagacaggcacagcatccatgacacagatgtgcggcacacctggaaaagcaactgcctccctctgcgcttctgggtgaacgtgattaagaacccccagttcgtgtttgacatccacaagggcagcatcacggacgcctgcctctctgtggtggcccagaccttcatggactcttgttcaacgtcagagcaccggctgggcaaggactccccctccaacaagctgctctatgccaaggacatccccagctacaagagctgggtggagagatactacgcagacatcgccaagctcccagccatcagtgaccaggacatgaatgcctacctcgccgagcagtcccgcctgcacgccgtggagttcaacatgctgagtgccctcaatgagatctactcctatgtcagcaagtatagtgaggagctcatcggggccctagagcaggatgagcaggcacggcggcagcggctggcttataaggtggagcagctcattaatgccatgtccattgagagctgagaggaggagcctcgcattcctgggaagagggacctgtccaagctgtcacactgggagtctcagatggaaggacaagtgatggggatcaggccccagagcttgctgtcccctgagaccccatcctggggagaggggaggactcctctccctacgccagccaagtttcgtcatagccagttccagctgggagagacagtgggcgtcgtccatcctcagtgagaacaccagagaacccggggccgggagaaggtggttcttcaagccgagaggcacgagctggggacagttctgcctctgtgactgctgctttgcatgaaaactcatttgatgtatattggggaaataatgagaactttatttaatttttttaagaaaaagggaaaaaaacagaaataaaacaaaaagccgccctgttaatcccgtccaacttttgtttaattctgatttctgtctcccttccatcttttctcccattcctccttctttatataatgcctatttccaaatgccagagaaagcagagatgctgagagacattggagagaaaatgactgtctccttttccttgaaattaaaaaaaaaaaaaaaaagagaaagaggagaagaagaatgatgagcacaagtatgcaccaaacacttcgcaaaaacagaggccagtaaaacctggaattatcccggcagccagaggagtatggaacttccagaactttgcacaaattgcaaagccatcaagagctcaccctggctgactggaaactgagctttatctaccacacacctgtatattctcatcttttgagaggagatgtgtacctagatagtaccaatgctttttgctactgttttttgttttgttttatttaatcctaaacctcaacaaatgaggagctggtctttgatatgtttcctttcaatttccctaaagttactatgagaagtggggtgaggtgggcctctcccagaccagacacctggcagccctgcctcatatcaatccctgtcataaaccaggcaccctggggaaacggcctggaggtgtgtgggccaggcctccacgaggttccatttgaaagttgatttggagacataggtgtttgactttggagttcactccaatcatccagtggtccctggcaattaaaaagaaaacaaaaatcaaacactgtttacagcaagcaatacttgaagagcataggttacagaagctgcagtatttattattatgctttctttctttcattctctcgtgcctggagaggggagaccacccttcgctcatatacggaagctcctgaccatctgggcctacagcacttcctcagtagaaatgactgtggcatgcccacgttactaccttctgcctctctttctgcctctcacggacttgtgagtgtgaaggacaagtggatgacttctcactggactttccttctctgtctcttctgatgatgcctaaaactatggataaccaattctcctgagtgtagattccaaacaaagagaccaaagctccatgcccaggtccaaaggccccatagaagccagtgggagtcatcgagaggaaaggcgctctgtgagtgtcaggaccttggtggccaggatagccatcagagtgtccaggcctcccacattaccttggatccgagcagccagctccaactgttctgcaagcagcactggagtcagggggtaggaggacaagtggaagcaaaggtgtgggactggggaagacaaagaggaacaagctgcccttcctcacttttcaaagggtcaggaatcctaggctatgatgctgggaagctagaccagctcctccaagagagactagaccagggtcattttctctgttattaactctgggctccagcttctccgtgccctgctttacctccaagtggttccaatttccaaaggccctgctgaccacatgtgattcccaggagagggctgggggaggggagcgcagaggtctggcttccatccttggcgtgtagctttggatcgctgtctaaccacacagcagacgttgcccggtctccccagctctagtttcttgcctgaatgcggctgacaaatgggaagagaaaagcattcagcaaaatactcaggaaacttgctgttttcattataattcacaaccagccatgccaaggccactttcttttgaaaatccacttctttaaagtttctcaggccctattagtagcctgaaggaaatactaatgactggccttccgcactaagccaaagtgtttgctcttcatagcactcaaagcttatcagcgcagagcccataatttatggagataaaaggaaaggagatataggtaagaagagtgtgaccaggagaccttatgctacctgtaaaaaagttcagcccaccccatctaacttctgagctctgtttgggtgaagattttctggccgcatggctgctcagactggcatccaggctttgctccaccaagaagttaaaggcagtcggacatctcagtagcatctctaccagcccttaactcaatgcatctacctggcatctcccagcagttacttttggagacgattcactgcccctggggcgtttccttgaaggtttgtggagagcgtggagaatgatggggcaatggccaattggagggtggagagtgaagagccggagctggctgtgagtggtttggccacatttctcaggattccatgagagacttggggaacttgggctgacaaaggaagtagcctggggcatccttaaggaaggaattaagaaaagggaaaaagctggactcaagccacgccatgagggtgaaaggttataaggccctgccccctttccagctgcccacctgttcctcctccacacctcttcgctttgggccaccaagaaccaatgaagtccacaccctttggatgagaaaaagagggagttggttggcctctcttctccctgttatccaatttgaggatattttgaccttgggtaaggatgaagtgttaaagccacagctcctctccacaagaagccattcatcttgggggaggcagagagggaagtctctctccaaagtctatccagcttcgcttcgtttcattgatctgcacaagagacaatgctctggaaaaggaagaggaccccagaagggtgcttggcaagacagaggatgctaatgggcaatggagagcactccctccagctggcccctgctgctgcctcccgtcctctgcatggggtcaggtgcttctgtgcttgctgtcctacctctctccacagcagggctctcaaaaccattttgatcccccattggcagagggttcccctctttacagagttcagtcattaaaagcatggatcagctgttaatctcattggaggagggaactgtttcctgcattcattcatctgggaaccttcttgagtagccactgtctgccagccactgctctagagatgggaaaacagcacggaacaaaaccaaggtctttcttccagcgaatttatatccttcaggaagctggttcctgccaccaacttagcaggcaacagttctcctcccctagtggcacagggtaccagttttgtaggaaaagtggtccagcaaaggaagaaagcagaccaacccagctgccttaccttattctggggccattcccccagcgatgagagctgctcttgtttctactgccaccatctcttctggctgcacttcacctgctgcttgagcttctgaccttccttcagttccaccaaatgaggacaggaaatagcagtcaagacccctggccctgctgagcgtgaaacagaagcaatggatgagtgctggacgaagaatggcctgggcagaacaaatagggagcatttgaaagcttctggctgataaatctccaggtgcatcccggttgccacgcctgcccccattaacctgctcctggtaaatactgatccagcagctgctccaggagaggccgtctttttttcccagccacgctgtgtcttgcatgagactcctggggcctgggcacagagagaaaagaattgagactcaggaggctcagtgggtgagaaaatgcaaagtggcttcacagacacagggctgtgggagcagatcgacggggaacttgggagatgaacttcagggccttccgacgccttgtctcaggaacatgctttgagaaaaatggtagcatcctttccataactcagtctctcttccctagtttccctgaagtgtgacgttttagtatctggagctcagtgatccccatgaatgagggataaagtttcactcttggtattttctaactagtgctagggaaagtcctgagacacgatcacagccactgcttggcatacagggcctccacccaataagcaaactggagattcctcagcctctcgtggacacccacatctcattcttctcacagcagagaagctctcccttcagcctgagctgtcttctttctgctgcagtgcagcctgctccctcctaccctggcctcaaggaaggtaggaaacatcttctgcatttcaaagtcctcactttgacttatttggccttcatcttggcatggaaggtggcaggcagaatggaaatactccccccaaacagaacagatattcttgcgtgtgtaagggcagaagggacaagctctctatcccatgagactaggggccggagcccacctgcctttccccacaacttttcctgctcaaacccactcctcttgacacactggaatctgtattatatatatttttaagaaaatacaatgatggttgtctggttttgttgtttttacaggtgttgtggaataaaaactgtaagaaaattaagtatttaaaatgttccaataaagtggggttttttgttattctaatatattattgtgtacctattgtaaatatgaaacactcctattttgcaagctgaggacacaatttgtactgttgttatatataaataaagtttactgaattaaaaaaaccttaaatctttaaataaaaaaaaaaaaaaaa

SEQ ID NO: 25 - DNA, 6007 bp, Homo sapiens
agccgcgcagacgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccacttcgacgcatcctgtggccaccccaacaagctcgggacatgaccatcttatgaaaatttcaagcagttcaagcactgtggctatccctggctacaccttcacaagcccggggatgaccaccaccctactagagacagtgtttcaccatgtcagccaggctggtcttgaactcctgacctcgggtgatctgcccaccttggcctcccaaagtgctgggattacagcgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcatcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtccagattcctcttgtaaaataacccactagtgcctgagctcagtgctgctggatgatgagggagatcaagaaaaagccacgtaagggactttatagatgaactagtggaatcccttcattctgcagtgagattgccgagacctgaagagggtaagtgacttgcccaaggtcagagccacttggtgacagagccaggatgagaacaaagattccatttgcaccatgccacactgctgtgttcacatgtgccttccgtccagagcagtcccgggcaggggtgaaactccagcaggtggctgggctggaaaggagggcagggctacatcctggctcggtgggatctgacgacctgaaagtccagctcccaagttttccttctcctaccccagcctcgtgtacccatcttcccaccctctatgttcttacccctccctacactcagtgtttgttcccacttactctgtcctggggcctctgggattagcacaggttattcataaccttgaaccccttgttctggattcggattttctcacatttgcttcgtgagatgggggcttaacccacacaggtctccgtgcgtgaaccaggtctgcttaggggacctgcgtgcaggtgaggagagaaggggacactcgagtccaggctggtatctcagggcagctgatgaggggtcagcaggaacactggcccattgcccctggcactccttgcagaggccacccacgatcttctttgggcttccatttccaccagggactaaaatctgctgtagctagtgagagcagcgtgttccttttgttgttcactgctcagctgatgggagtgattccctgagacccagtatgaaagagcagtggctgcaggagaggccttcccggggccccccatcagcgatgtgtcttcagagacaatccattaaagcagccaggaaggacaggctttcccctgtatatcataggaaactcagggacatttcaagttgctgagagttttgttatagttgttttctaacccagccctccactgccaaaggccaaaagctcagacagttggcagacgtccagttagctcatctcactcactctgattctcctgtgccacaggaaaagagggcctggaaagcgcagtgcatgctgggtgcatgaagggcagcctgggggacagactgttgtgggaacgtcccactgtcctggcctggagctaggccttgctgttcctcttctctgtgagcctagtggggctgctgcggttctcttgcagtttctggtggcatctcaggggaacacaaagctatgtctattccccaatataggacttttatgggctcggcagttagctgccatgtagaaggctcctaagcagtgggcatggtgaggtttcatctgattgagaagggggaatcctgtgtggaatgttgaactttcgccatggtctccatcgttctgggcgtaaattccctgggatcaagtaggaaaatgggcagaactgcttaggggaatgaaattgccatttttcgggtgaaacgccacacctccagggtcttaagagtcaggctccggctgtagtagctctgatgaaataggctatccactcgggatggcttactttttaaaagggtagggggaggggctggggaagatctgtcctgcaccatctgcctaattccttcctcacagtctgtagccatctgatatcctaggggaaaaggaaggccaggggttcacatagggccccagcgagtttcccaggagttagagggatgcgaggctaacaagttccaaaaacatctgccccgatgctctagtgtttggaggtgggcaggatggagaacagtgcctgtttgggggaaaacaggaaatcttgttaggcttgagtgaggtgtttgcttccttcttgcccagcgctgggttctctccacccagtaggttttctgttgtggtcccgtgggagaggccagactggattattcctcctttgctgatcctgggtcacacttcaccagccagggcttttgacggagacagcaaataggcctctgcaaatcaatcaaaggctgcaaccctatggcctcttggagacagatgatgactggcaaggactagagagcaggagtgcctggccaggtcggtcctgactctcctgactctccatcgctctgtccaaggagaacccggagaggctctgggctgattcagaggttactgctttatattcgtccaaactgtgttagtctaggcttaggacagcttcagaatctgacaccttgccttgctcttgccaccaggacacctatgtcaacaggccaaacagccatgcatctataaaggtcatcatcttctgccacctttactgggttctaaatgctctctgataattcagagagcattgggtctgggaagaggtaagaggaacactagaagctcagcatgacttaaacaggttgtagcaaagacagtttatcatcagctctttcagtggtaaactgtggtttccccaagctgcacaggaggccagaaaccacaagtatgatgactaggaagcctactgtcatgagagtggggagacaggcagcaaagcttatgaaggaggtacagaatattctttgcgttgtaagacagaatacgggtttaatctagtctaggcaccagatttttttcccgcttgataaggaaagctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacaggaatgtaaatgtcttactggaaatgacaagtttttgcttgatttttttttttaaacaaaaaatgaaatataacaagacaaacttatgataaagtatttgtcttgtagatcaggtgttttgttttgtttttttaattttaaaatgcaaccctgccccctccccagcaaagtcacagctccatttcagtaaaggttggagtcaatatgctctggttggcaggcaaccctgtagtcatggagaaaggtatttcaagatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaagaattgctactcgaaggtgccagaatgacacaaaggacagaattcctttcccagttgttaccctagcaaggctagggagggcatgaacacaaacataagaactggtcttctacactttctctgaatcatttaggtttaagatgtaagtgaacaattctttctttctgccaagaaacaaagttttggatgagcttttatatatggaacttactccaacaggactgagggaccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgtaaactggttcaaaaaaaaaaaaaaaaaaaaaaaaa

SEQ ID NO: 26 - DNA, 6831 bp, Homo sapiens
ccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggctagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagagaggctgctgtcattgcgctgtggaatttcacagatgagaaccacgcctagccaaaatcacttttcctgtttgcctcagtgacacagctgcagggaccctcgtggatgttgtattaaataaatttgacctttgctctttgcagatctgtgaaatgttgtcttctgaggggccacatgcatctatagtgctgaggactccttgggcctctgaagtcacagagagaaccgagcaggtctatgtttttgttttgttgttttgagacggagattcgctcttgttgcccgggctggactgcagcggcgcaacctctgctcactgcaacctccgcctcctgggttcaagcagttctcctgtctcagcctcccgagtagctgggattacaggcacatgtcaccacgcctggctaatttttgtatttttagtagagatggggtttcaccacgttggccaggctgatctcgaatgcctgacctttggtgatctgcccgccttgtcctcatgtgtgctccacaggcctttgggttgggattgcaggcgtgagccaccatgcccagcctagactcttttgacaatatgatgaaagctgttggttcctttccccaacacacacacaccgagttgtatcacgaaaatgtcatacaatttccaggttttctgagtggtgggctcagattgaggtcaaaggatcagacgacctctaacgaccttcatgtctctgttgatgatctggggacagccagatcccctgtgtccagggagttccttagtcccttgccaccaccagagaagggcaattgccacgggagctgcaaagaccctattcctactcctggtgccttacttatgcagcacgactgaattttttgttttgttttgttttgttgagacaggggcttgctctgttgcccaggctggagtgcagtggcacaacaatggctcaccgcagcctcgaacccctgggctcaagcgatcctcccatctcagcttcctgggtagctgggaccagaggcgtgagccgccatagctggctaatttttaattttttttttgcagagatgaggtttcaccatggtgcccaggctggtctcgaacttctgggctcaagtgatcctccctccttggcctcgcaaagtgctgggattgcaggcatgagccaccgcccccggcctgtggagcacacatgagtttaaaattactttcccttctgcctatatttccgaggaggaaacttcatgcgcagggatctttcttagtggatttaatggctaaaaggtctgtctgaatccaggacgctggctttagccttcctcggcagctgccgtaaccccggtgtctaaacctgaagcatcccaggagcacccactccaggagttttctcggccgcggaactcattagttagagcgccctcttgtgttctcatgtggtaatcggtcactgaaggacttaaaatggtccttagccaacacacagtaaaacttttccctcttctgaccccaagaggtcagccacccatttcatgagcatatactggtcgccccatcagcgttctctgattggctaactgaacccactccccgacctagactcaagacaggcgaagtgacgcttaggtcaacattcactcactaaagcaacgactgtcgggcgattttgtctcccgctggttttggaatggtgtctggagacatttttggttgtcacagctgggtgggtgtgctcccggcatctggtgggtagaaaccaagcatgctcctaaacatcctacaggcacagaaccgtctcccacgaccaagcatgatcaagtcccaaatgccaataatggccaggttgagaaactctgcacagaagcatccagttatttgtctgtttgctcaacaagcttgtgctcatcatgctctgtgttcctgacgctgtgctgggtgttggcggtgggaagattacaagagtcacatggcagctgtcctcctggaaggtacaacccagtagagatgcagactaacagagagccaattacaaagcagtgtgacaagcgtcatggtggaaaattaaaagctcaaacaagggcacatgggaggggcttccaacacagactttgggggatccaggaaggtctaagaggaaagtgggtctcaccaaagccttgaccataggcagagggtaccagtggaaaaggtggggtgaagaacattgaggacaaaaggaagaagtgcaggaaggccctgaggcaagggagtggggggtgccctggagggatggcagcagggcagtctgtcagacccaagtggcctccagccctagaagccaattagtcctcctcaaaaagctgtcactgtcccctaagaattgctgccaggctcccactggcctgactcagtctttgagagtcttaaggaggaggtctctgaaaggtacacaccaagaactctccccagcacagctgtttttaagactctccaccagcgtcattggcgtgttgggaagaaaccctctgccacagaggccagcttcagcctttgcctaacaccgcaagggcaaatggaaaggtaaacgggaaggagatgtctccccagcaggctatttgaggacagtcttccctgcagaagatctcaacctggggtccacagagtggaaatgttagagtagggagctaggcaaacatgagcaggacaggtgagggcccccacaggaatgtcaggctaccatcaggtgatggtcaggtggttgttaaactgtctctgtaaaataataattggttgcagccagctccaagcaaggacagtctctcaatagatacaaaacaccctgatctggtgatcagccgcttcccgataagatctcaggagctgggcaagcagcctggagcatgcgcaccaagaggcaaaatggcggaatttaaccagtatatgacctaccttcctctgggaacgcacgactggtaaggggaaaaatgcctcaagtgagcatgcgcgcaacttcagtaatcacactgtgcatgcgaccccttccaagtgctggcaggtcaccacatacgcggacagcctgctgcaagggaagaatcaggggagatgagacgtaaatcccagaactatgccaaatacataaaaccccaagttaagggtcaggcagggcacttagatctctcaagttgcctgcctgacccaagtgtagtgtacttccttttgttcctgctctaaaactttttaataaactctcactcctgctctaaaa

SEQ ID NO: 27 - DNA, 7748 bp, Homo sapiens
aaggacaggatgtttctgagccaagttgaagcaaaagaaactttttccagcatgtcaggaacgaagctgacgttccattaagaaaaaaaaaaaaaaaaaaagaagtgctagaggaaggagtaagaggtgaaaaggcaccagaattcagacggagctttaaattccagacagggccagcgttgggagcacgtaggaggcgcccctcggaaaggagccggagacccagctgacttcgcacttgagctccagccccgtggacatttcctgttctgcctctggaaattcaagctgaaagttacaaaacatccttttccctggaaccaagtgcttggttgggagaccatgccctccccttccttcctcggaactcctccctgatcgccccgtggcttccccaggagagatgcgaaatcagcggtagcaggtggcgcagaagggagaggggagcgaccctggggaccgactctggggaccctcgccgaagagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 28 - DNA, 1126 bp, Homo sapiens
gtggcgagggcggtgcctgggggcaggggcctcctcggagggcggcggggacagacccgtcgccccggctccgcagccccgccccggccccgcctccgctccggccgccgaaggctataagatctaggaacccgagccggtggtagggcgggcgcggaccgtgctgggagcggcgcggctggagcgcagcgccgaagggactggcagggctgaagtgtgcgggacagcaagcccccgaatagccccggctgccacctcgcaggacccaaggccacgcgcgccgggcccagctgagccgcctcatgaagccgcccgcggcgcagggcagccccgcggccgccgcggccgcagccccggccctggactcggcggccgcggaggacctgtcggacgcgctgtgcgagtttgacgcggtgctggccgacttcgcgtcgcccttccacgagcgccacttccactacgaggagcacctggagcgcatgaagcggcgcagcagcgccagtgtcagcgacagcagcggcttcagcgactcggagagtgcagattcactttataggaacagcttcagcttcagtgatgaaaaactgaattctccaacagactctaccccagctcttctctctgccactgtcactcctcagaaagctaaattaggagacacaaaagagctagaagccttcattgctgatcttgacaaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttgaactgaagtctgcaaaaaaaaaaaaaaaaaa

SEQ ID NO: 29 - DNA, 532 bp, Homo sapiens
gagaaaccagagactgtagcaactctggcagggagaagctgtctctgatggcctgaagctgtgggcagctggccaagcctaaccgctataaaaaggagctgcctctcagccctgcatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaa

SEQ ID NO: 30 - DNA, 3072 bp, Homo sapiens
ctctacccggttggcaggcggcctggcccagccccttctctaaggaagcgcatttcctgcctccctgggccggccgggctggatgagccgggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaaccagtgaaaaaaaaaaaaa

SEQ ID NO: 31 - DNA, 2018 bp, Homo sapiens
gagaggcaggcccatcgcaaggctgactgatccttcaaaggagcctcccagctaaaagccagcaggagagagaccttggccaccaagggtctgccagctcctggtggtccccactccagccacctgccagctcgagcctgaccctcgcctccaccctggctgctgcctgtaccgctctcagggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcgcaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtcttgaaaggggactataaaacaccagccaatctgaaaggatattttcaggtgaaccagaacagcacctcctcccacttaggaagctcgtgatttccagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctcatttgtttgtgccttactttactgaaaaaaaaaaaaaaaaaa

SEQ ID NO: 32 - DNA, 1753 bp, Homo sapiens
cagccccgcccctacctgtggaagcccagccgcccgctcccgcggataaaaggcgcggagtgtccccgaggtcagcgagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcacggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccaccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcgcagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcggggcaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatccacgtgaaaaaaaaaaaaaaaaaaaaaaaaaaaaaaaaaaaaaaaaaaaaaaaaaaa

SEQ ID NO: 33 - DNA, 3139 bp, Homo sapiens
gagtgctggctttctcttaaagggtgagtgcgtgcgcccaggtggtttggcctgtgtgcgctagttacttgcacgcgcttcttgagtctcaaaacacagagctctagtaaacttcagggggcggattcgtcaattacagttgcggaagaagactcgactcgaagagcggtccgccaccagggctctttcggcagcgcccccagcgggcggggctcttgggcggggaagcaggagagggccgaccgagcgcaacaaagctgagcggcgcgtcgcttcaggaacgaagaagcctcgttatgcaagcgaaaaacaaagatgctttgcagcctattaaggaagacaggactgggaaggcccaggatgatgctttctggcttcaatcacttattacggatgcattccatgataaaggatttcagaaaataaaagaatactttcaacagaaagagagccactttcctcaaaaatataatcgtcttctattataccgtcttgacagatcaataaataaggaactagataaaaatgaatttcagtctgtgtcactgttgctgaaatgtattcagcgattcctcgtagatggcctgaaagaagatgaacctctgctaattcggcagggactgatcccaaagctagtttcctggtttgaaagaacaacaggaattctgacctcggaaggcctagcctcagacacgtcgctgatttgtgttatagaagatttctttgacactgcattgattatttccaggagtagtagtgaagggaaaattcagatgttggattccttcctacttagcttaggattcctggtgacagaaaagactgtaaatcatttgcttcaacaggagggcttgaagacttttaactgcattttgcacgctgtccctcgagaagagagaaaaaaattccctttgtcagaaggcatgtgtcatcttatgaaagaccttgcaaggacactcttgactgtgggtgattatgaccagcaggttgctatttctgaagcgctgtgtagactgacgattaaaaaatcaagggatgaacttgtccataaatggtttgatgatgaagtcattgctgaagctttcaaagaaattaaggatcgagaatttgagacggacagtagacgttttctcaatcacctaaacaacagacttggtgaccaaagaagggtgtattcatttccgtgtattgctgcttttgctgatgagcatgagatgagaaaaccagcggatgaaaaattagagaaattttggatcgacttcaacctaggaagtcagagtgtcactttttatatagacaatgctgagaatactctatgggactcagtgacacttccgaaggaagcggtgatgaatttcagcataacagaaacggagaagataaagatatttatcatttacctgaagaagcccatgattatcagctacaaagaagtcatgaaaatagaaatccattttgatttgcagttcaacatatcacaagtttccattcaagctttaggagaagacaaacagatgttgcctgaccagacgaaaatctcctcagaactttttagtaagtctgataaagaagacagggagagtcccagtggccttgaaagagaaacagagcaggcagaagaatccactaacatggtggagtttatgagtgctgaagatgaccgctgcctaataactctccacttaaatgaccaatctgagccacctgttattggggaacctgcctctgatagtcaccttcagccggtccctccgttcggggtccctgacttcccgcaacaacctaagtctcattacagaaaacatctcttctctgagagtaatcaagattcaagtaccagtgaactatcttggaccagtaaccagaaaaagaaatccctaaaatcatattccagtagaaagaagacaagaaccagaagtaatttgagaatcttgccagttttccctcccagtagtggcagtggccatgagaaagaccaagctaagcttctatcaccatcagagaaagaaatacccgagcaaaataacaccacatctccaaagacttctgaacaaaaattccaagatagttttgcttttttgactgctgaagattctgcccagaaaacagagcttcaagatcctcactcactgagtgagctctcttccttgaagcactcagaagatgaagaaaaacctaagattgtgaaccaagaatcactaacagaaagtactagcttgaaacataagctgagaaacttggaagacaaagacataccagaaggtagttttgctaagtcacaacaatcaagattggaagaagaggttgctccgggatcccctttctcaataacagaagaaagagagttgccagaaggaatttccacttcatccctagaagttgtgccagagaacttgaacggttctgccattctcccaacctttgaaaacttcactaaaaaacggaaaagaaaatatgagcttaggtacagaaagcgtccgtttaattcagaaaatgcaaagaaagcaccggattgcctaataaaacttttaaaccagatgcaactgttcagactcaataaactagagcgctttcaaaatttggttcttcaagagttgagcagtcttaagcaggatattcaggccctggaacaccttgagaaggaggttctggaattctgggggaaacagtctgctgatctgcaatctttctgtgatctgcaagtgctgaggttcaattcaactcagacttcataagaaagccaaagcctggttttatgattgcagccctcagcctgggctgcctgaagacgaagagaaagagcaaggttattgttggctcaggccttgttagccagacttcgtgctctgtacgcattcaatttcctcccctccaaacatcatccctgggaactgctgagttcagatagaatatatgttggtagtttgcagttgggttattatccatttgttcataaaaattaaccttttgtattaaaatttggtcagatagtattaatagaaagttcaggatgttaaacaacttggagtggtgttgctttttttttataaaagtaaaatggacttttttttgtttgagaaatgtcttcaagttttgtgtgaataaaacactttagcagcatctgtataaaaaaaaaaaa

SEQ ID NO: 34 - DNA, 7505 bp, Homo sapiens
gagggcggggcgggaaggcggcgaggagccgagctgggtgcggtgaggcgcgcagatcaccgcggttcctgggcagggcacggaaggctaagcaaggctgacctgctgcagctcccgcctcgtgcgctcgccccacccggccgccgcccgagcgctcgagaaagtcctctcgggagaagcagcgcctgttcccggggcagatccaggttcaggtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccagggcgagctggagcggcagctgctgcaggccaaccccatcctggaggccttcgggaacgccaagaccgtgaagaatgacaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggctctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgctacga

SEQ ID NO: 35 - DNA, 2454 bp, Homo sapiens
catactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggagagacgtttttccagccctcaccttggcgcctggcttctattttactcgggttactctgtggtgccctgtgtggtgttgtcatggggatgataattgttttcttcaaatccaaagggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaatttacttttctctataccaaatcacccatggaatagttattgaacacctgctttgtgaggctcaaagaataaagaggaggtaggatttttcactgattctataagcccagcattacctgataccaaaaccaggcaaagaaaacagaagaagaggaaggaaaactacaggtccatatccctcattaacacagacacaaaaattctaaataaaattttaacaaattaaactaaacaatatatttaaagatgatatataactactcagtgtggtttgtcccacaaatgcagagttggtttaatatttaaatatcaaccagtgtaattcagcacattaataaagtaaaaaagaaaaccataaaaaaaaaaaaaaa

SEQ ID NO: 36 - DNA, 2063 bp, Homo sapiens
aaaccctgaagagcccaagcaatgtggttgtaaaatttgcaaaataagattaaatcttaactgcaatctgttaacactgctgtctcctttcactctttctcctatatcacactttcccacatgttggatggccttggagtggtagccataagcatttttggaattcaactaaaaactgaaggatccttgaggacggcagtacctggcatacctacacagtcagcgttcaacaagtgtttgcaaaggtacattggggcactgggggcacgagtgatctgtgacaatatccctggtttggtgagccggcagcggcagctgtgccagcgttacccagacatcatgcgttcagtgggcgagggtgcccgagaatggatccgagagtgtcagcaccaattccgccaccaccgctggaactgtaccaccctggaccgggaccacaccgtctttggccgtgtcatgctcagaagtagccgagaggcagcttttgtatatgccatctcatcagcaggggtagtccacgctattactcgcgcctgtagccagggtgaactgagtgtgtgcagctgtgacccctacacccgtggccgacaccatgaccagcgtggggactttgactggggtggctgcagtgacaacatccactacggtgtccgttttgccaaggccttcgtggatgccaaggagaagaggcttaaggatgcccgggccctcatgaacttacataataaccgctgtggtcgcacggctgtgcggcggtttctgaagctggagtgtaagtgccatggcgtgagtggttcctgtactctgcgcacctgctggcgtgcactctcagatttccgccgcacaggtgattacctgcggcgacgctatgatggggctgtgcaggtgatggccacccaagatggtgccaacttcaccgcagcccgccaaggctatcgccgtgccacccggactgatcttgtctactttgacaactctccagattactgtgtcttggacaaggctgcaggttccctaggcactgcaggccgtgtctgcagcaagacatcaaaaggaacagacggttgtgaaatcatgtgctgtggccgagggtacgacacaactcgagtcacccgtgttacccagtgtgagtgcaaattccactggtgctgtgctgtacggtgcaaggaatgcagaaatactgtggacgtccatacttgcaaagcccccaagaaggcagagtggctggaccaaacctgaacacacagatacctcactcatccctccaattcaagcctctcaactcaaaagcacaagatccttgcatgcacaccttcctccaccctccaccctgggctgctaccgcttctatttaaggatgtagagagtaatccatagggaccatggtgtcctggctggttccttagccctgggaaggagttgtcaggggatataagaaactgagcaagctccctgatttcccgctctggagatttgaagggagagtagaagagatagggggtctttagagtgaaatgagttgcactaaagtacgtagttgaggctccttttttctttcctttgcaccagcttcccgatacttcttggtgtgcaagaggaagggtacctgtagagagcttctttttgtttctacctggccaaagttagatgggacaaagatgaatggcatgtcccttctctgaagtccgtttgagcagaactacctggtaccccgaaagaaaatcttaggctaccacattctattattgagagcctgagatgttagccatagtggacaaggttccattcacatgctcatatgtttataaactgtgttttgtagaagaaaaagaatcataacaatacaaacacacattcattctctctttttctctctaccattctcaacctgtattggacagcactgcctcttttgcttacttgctgcctgttcaaactgaggtggaatgcagtggttcccatgcttaacaaatcattaaaacaccctagaacactcctaggatagattaatgtagtaaaaaaaaaaaaaaaaaaaaaaaaaaaaaaaaaaaaaaaaaaaaaaa

SEQ ID NO: 37 - DNA, 5479 bp, Homo sapiens
agcgagctcccggggaaaagcaacggtgtcctcctaagcctgaggccaccgcgaccgagccgagccaggctaagggaccagtgtctccctgccccccccccacctctaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagagatggagaagctgctgctccctgctgtagacttagagcagtggtaccaggagctgatggccgggctggggactggccccgctgcagcctcccctcactcttctcccccgcctctgcccgccaaagcttcccgtcagctgcaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagaagaggtttttccgcttcactatggtgactgagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaagtgagtggaa

SEQ ID NO: 38 - DNA, 1907 bp, Homo sapiens
agaatggagccctcctggcttcaggaactcatggctcaccccttcttgctgctgatcctcctctgcatgtctctgctgctgtttcaggtaatcaggttgtaccagaggaggagatggatgatcagagccctgcacctgtttcctgcaccccctgcccactggttctatggccacaaggagttttacccagtaaaggagtttgaggtgtatcataagctgatggaaaaatacccatgtgctgttcccttgtgggttggaccctttacgatgttcttcagtgtccatgacccagactatgccaagattctcctgaaaagacaagatcccaaaagtgctgttagccacaaaatccttgaatcctgggttggtcgaggacttgtgaccctggatggttctaaatggaaaaagcaccgccagattgtgaaacctggcttcaacatcagcattctgaaaatattcatcaccatgatgtctgagagtgttcggatgatgctgaacaaatgggaggaacacattgcccaaaactcacgtctggagctctttcaacatgtctccctgatgaccctggacagcatcatgaagtgtgccttcagccaccagggcagcatccagttggacagtaccctggactcatacctgaaagcagtgttcaaccttagcaaaatctccaaccagcgcatgaacaattttctacatcacaacgacctggttttcaaattcagctctcaaggccaaatcttttctaaatttaaccaagaacttcatcagttcacagagaaagtaatccaggaccggaaggagtctcttaaggataagctaaaacaagatactactcagaaaaggcgctgggattttctggacatacttttgagtgccaaaagcgaaaacaccaaagatttctctgaagcagatctccaggctgaagtgaaaacgttcatgtttgcaggacatgacaccacatccagtgctatctcctggatcctttactgcttggcaaagtaccctgagcatcagcagagatgccgagatgaaatcagggaactcctaggggatgggtcttctattacctgggaacacctgagccagatgccttacaccacgatgtgcatcaaggaatgcctccgcctctacgcaccggtagtaaacatatcccggttactcgacaaacccatcacctttccagatggacgctccttacctgcaggaataactgtgtttatcaatatttgggctcttcaccacaacccctatttctgggaagaccctcaggtctttaaccccttgagattctccagggaaaattctgaaaaaatacatccctatgccttcataccattctcagctggattaaggaactgcattgggcagcattttgccataattgagtgtaaagtggcagtggcattaactctgctccgcttcaagctggctccagaccactcaaggcctccccagcctgttcgtcaagttgtcctcaagtccaagaatggaatccatgtgtttgcaaaaaaagtttgctaattttaagtcctttcgtataagaattaatgagacaattttcctaccaaaggaagaacaaaaggataaatataatacaaaatatatgtatatggttgtttgacaaattatataacttaggatacttctgactggttttgacatccattaacagtaattttaatttctttgctgtatctggtgaaacccacaaaaacacctgaaaaaactcaagctgacttccactgcgaagggaaattattggtttgtgtaactagtggtagagtggctttcaagcatagtttgatcaaaactccactcagtatctgcattacttttatctctgcaaatatctgcatgatagctttattctcagttatctttccccataataaaaaatatctgccacc

SEQ ID NO: 39 - DNA, 2886 bp, Homo sapiens
cgatcgagggagctgagccgagagaaagagccgccgggcgctgcctcgccagacctcgctgggaccccggggccaccgggaggcacttttgtggaggggggagggggggcgacctcggcagcctcggcgcacgaagcgtccgagggcagcgtggggcgggctgcgacctctgcatcggtggactgcatttttaattaaggattcccagcagctctttgggatttttacagcttccactcatgtgttgacacccgcgtccaggagaaactcgctccaagtgcatctagcgcctgggacctgagacggcgttggcctttcgtgcatgcaaatccagggatttaggttttgtttgggatttccttttctttctttccttttttttttctttttgcagggagtaagaagggagctgggggtatcaacaagcctgcctttcggatcctgcgggaaaagcccatgtagttaagcgctttggtttaaaaaaaaggcaaggtaaaggcagggctttccagacacatttaggggttcgcgcgagcgctttgtgctcatggaccagccgcacaacttttgaaggctcgccggcccatgtggggtctttctggcggcgcgccgcctgcagcccccctaaagcgcgggggctggagttgttgagcagccccgccgctgtggtccatgtagccgctggccgcgcgcggactgcggctcggcgtgcgcgtgttcccggccgtcccgcctcggcgagctccctcatgttgtcgccctgcggcgccccttcgacgacaggctgtgcgcggtctgcacggcgctccgcggcggagcttcatgtggggctgcgacccgcgcagccggcgcctcgctgagggaacggacccccggtaaccggagaccgcctcccccccacccctggcgccaaaggatatcgtatgttcaggtccaaacgctcggggctggtgcggcgactttggcgaagtcgtgtggtccccgaccgggaggaaggcggcagcggcggcggcggtggcggcgacgaggatgggagcttgggcagccgagctgagccggccccgcgggcaagagagggcggaggctgcggccgctccgaagtccgcccggtagccccgcggcggccccgggacgcagtgggacagcgaggcgcccagggcgcggggaggcgccggcgcgcagggggccccccgaggcccatgtcggagccaggggccggcgctgggagctccctgctggacgtggcggagccgggaggcccgggctggctgcccgagagtgactgcgagacggtgacctgctgtctcttttcggagcgggacgccgccggcgcgccccgggacgccagcgaccccctggccggggcggccctggagccggcgggcggcgggcggagtcgcgaagcgcgctcgcggctgctgctgctggagcaggaactcaaaaccgtcacgtactcgctgctgaagcggctcaaggagcgctcgctggacacgctgctggaggcggtggagtcccgcggcggcgtgccgggcggctgcgtgctggtgccgcgcgccgacctccgcctgggcggccagcccgcgccgccgcagctgctgctcggccgcctctttcgctggcccgacctgcagcacgccgtggagctgaagcccctgtgcggctgccacagcttcgccgccgccgccgacggccctaccgtgtgctgcaacccctaccacttcagccggctctgcgggcccgaatctccgccacctccctactctcggctgtctcctcgcgacgagtacaagccactggatctgtccgattccacattgtcttacactgaaacggaggctaccaactccctcatcactgctccgggtgaattctcagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactccccgacgctggacgcgcccggcggccgcgccctggtcgtgcgcaaggtgccccccggctactccatcaaggtgttcgacttcgagcgctcgggcctgcagcacgcgcccgagcccgacgccgccgacggcccctacgaccccaacagcgtccgcatcagcttcgccaagggctgggggccctgctactcccggcagttcatcacctcctgcccctgctggctggagatcctcctcaacaaccccagatagtggcggccccggcgggaggggcgggtgggaggccgcggccaccgccacctgccggcctcgagaggggccgatgcccagagacacagcccccacggacaaaaccccccagatatcatctacctagatttaatataaagttttatatattatatggaaatatatattatacttgtaattatggagtcatttttacaatgtaattatttatgtatggtgcaatgtgtgtatatggacaaaacaagaaagacgcactttggcttataattctttcaatacagatatattttctttctcttcctccttcctcttccttactttttatatatatatataaagaaaatgatacagcagagctaggtggaaaagcctgggtttggtgtatggtttttgagatattaatgcccagacaaaaagctaataccagtcactcgataataaagtattcgcattatagttttttttaaaaaaaaaa

SEQ ID NO: 40 - DNA, 5537 bp, Homo sapiens
gaacccggcgaggaaatacatgcactggctgagaatcgcccgcgccagggcgcaacgccacaaggtgtagggagtgtgcggggtggggcgaaaggggacccaagagtccctgtggctcggagtgccgggccgtcggttcttcattcctgccctcggggcagacggagtgaccccggcccccactccccgccccgaccatggtagtgttcaatggccttcttaagatcaaaatctgcgaggccgtgagcttgaagcccacagcctggtcgctgcgccatgcggtgggaccccggccgcagactttccttctcgacccctacattgccctcaatgtggacgactcgcgcatcggccaaacggccaccaagcagaagaccaacagcccggcctggcacgacgagttcgtcaccgatgtgtgcaacggacgcaagatcgagctggctgtctttcacgatgcccccataggctacgacgacttcgtggccaactgcaccatccagtttgaggagctgctgcagaacgggagccgccacttcgaggactggattgatctggagccagaaggaagagtgtatgtgatcatcgatctctcagggtcgtcgggtgaagcccctaaagacaatgaagagcgtgtgttcagggaacgcatgcggccgaggaagcggcagggggccgtcaggcgcagggtccatcaggtcaacggccacaagttcatggccacctatcttcggcagcccacctactgctcccattgcagagacttcatctggggtgtcataggaaagcagggataccagtgtcaagtctgcacctgcgtggtccacaagcggtgccacgagctcataatcacaaagtgtgctgggttaaagaagcaggagacccccgaccaggtgggctcccagcggttcagcgtcaacatgccccacaagttcggtatccacaactacaaggtccctaccttctgcgatcactgtgggtccctgctctggggactcttgcggcagggtttgcagtgtaaagtctgcaaaatgaatgttcaccgtcgatgtgagaccaacgtggctcccaactgtggagtggatgccagaggaatcgccaaagtactggccgacctgggcgttaccccagacaaaatcaccaacagcggccagagaaggaaaaagctcattgctggtgccgagtccccgcagcctgcttctggaagctcaccatctgaggaagatcgatccaagtcagcacccacctccccttgtgaccaggaaataaaagaacttgagaacaacattcggaaagccttgtcatttgacaaccgaggagaggagcaccgggcagcatcgtctcctgatggccagctgatgagccccggtgagaatggcgaagtccggcaaggccaggccaagcgcctgggcctggatgagttcaacttcatcaaggtgttgggcaaaggcagctttggcaaggtcatgttggcagaactcaagggcaaagatgaagtatatgctgtgaaggtcttaaagaaggacgtcatccttcaggatgatgacgtggactgcacaatgacagagaagaggattttggctctggcacggaaacacccgtaccttacccaactctactgctgcttccagaccaaggaccgcctctttttcgtcatggaatatgtaaatggtggagacctcatgtttcagattcagcgctcccgaaaattcgacgagcctcgttcacggttctatgctgcagaggtcacatcggccctcatgttcctccaccagcatggagtcatctacagggatttgaaactggacaacatccttctggatgcagaaggtcactgcaagctggctgacttcgggatgtgcaaggaagggattctgaatggtgtgacgaccaccacgttctgtgggactcctgactacatagctcctgagatcctgcaggagttggagtatggcccctccgtggactggtgggccctgggggtgctgatgtacgagatgatggctggacagcctccctttgaggccgacaatgaggacgacctatttgagtccatcctccatgacgacgtgctgtacccagtctggctcagcaaggaggctgtcagcatcttgaaagctttcatgacgaagaatccccacaagcgcctgggctgtgtggcatcgcagaatggcgaggacgccatcaagcagcacccattcttcaaagagattgactgggtgctcctggagcagaagaagatcaagccacccttcaaaccacgcattaaaaccaaaagagacgtcaataattttgaccaagactttacccgggaagagccggtactcacccttgtggacgaagcaattgtaaagcagatcaaccaggaggaattcaaaggtttctcctactttggtgaagacctgatgccctgagagcccactgcagttggactttgccgatgctgcaagaaggggtgcagagaagactcctgtgttggagacactcagcaggtcttgaactacttctcctcctcggagccccagtcccatgtccactgtctatttattgcattcccttgccccaggccacctcctccccctcccacctggtgaccagaaggcgctctcggttcttgtctcaccagtaatgcagactcattgggtcagcaattagctgtatacactgccgtgtttggaccattggcaagcctggttccactcctcaggggctcctggcagtgaagcaacttcagttcttttactgcaaagaacagaaaaaagaaagaaagcaaacaagaagactccggctctgctatcggacacagatcctgatccctcttgcttcttttccctcctgcaccgcagcttgccatccctgcccttctgtcctggagaagagactggtgcttctccgcacacacgagggagggcgcccttgaggcatgccctctgagggagggagaccagagatgcagggattggccagctgggttggtttgctctggaatggctaactcttgcctgctttggttttagcttttcagcatgccaaagtcatgtaagtttgtgtcttgtggaagaaatcctctttgtggaaaaagaaacagggttttgaactctgttaacatttgaaaaatatattttcaaattcactttctaattggccaaaagagatgagttccagtctgaatacaggtagatattaaagggctaataaaaaatgagaaaccggtcgtccaaggtggatgctgtcaatgcccgagtgacacatgagagctgtatgaattgagagaaaaggcaacaagtagcattcttcatcattcaagttctacctggacacaaaggcgaggaccctggggttccaacaaagctcagctcccagattctctttccagtttcatcctaagttcctagcataaacactatttattttctgcagcagtgtgttatttttgcgcacttatacaaaatggtagtactactgtgttgtggtttttaaacattaaacatgtaaagttatatacgaaatatctgcttttggaataagcagaatgaggctaaacatgggttatacaaagggtatctggaaactgaagagcaacttgttagaaaactgacaatgtcgcaagatgtactcagttttgtttctgtgtgacatgcaatggcaactcatgtggacactattgaagggatgtgacattacctcctgtagatatgctaacagtgttattctttcatttccaagggttctctgtggctttgtgtatatgtttcccagaggtcatttgattacctaatttactgaactgatttagcagggaatggaatccattccaactattgcacgtggatttcccagctgcccctaaatatatatacttgtgagtggcaaagtggcactaatgaagcttttgccttttgtacatttgagatttttgtatatagtgtttgctgcaaggcctgtggaattaattcgttgcatatagaggtatcaactgctgcatgttcaggcatattataaaactttagtctatgaaagaataattataataatgtccaggtgcaatactctgtaagtctattggttcaagttaccgagagataggtgtgttcctttatgggggatgggggggtgtgttggggattctttgtattgtttatttcattttggtttattttaaaagatgtaaacatatattaagctatattaaatctcacatacagttcttctgtgctctattataccctgatagagatgggggagagaaaggaatgtttttgatggtggtttcaaagctcggacagtaactatcttgagcccattagagagtctgtgtccatatttgcatctggctggtcatagcctttgttactaatgatgacattcagttctcttttgtttttattttttaaaaactcaggtgtaattattatctgttcttaagataattgcaaatattaaatattatgatatatcaattcatgtgtttggcataccagtgaatgatgaagaacatgagattaatttaatttatcttcggtaacttgacattctggagagagactatcttctggagttgagtacaagcacagaaacatctttacggtggcatcatctcattttttaggaagacatgataatactgcccatcatattcatgtgtaactactgttctttcttctgctttcttcaccataataaactttggacaaccaagcaagctctaaccgcaatgccagatggccttgtccgagggcctagtgtttgcacggcagtgggaactgggcctttcctacaggacaactggcaagtttgctgggaagtcaaataatacattccacctggcagctgaaggcagccagtcagtctgtcccagaaagggcccttttcagcacccaaagctgggctggctgggatgcctctggctggtgaagttctcacataggctgatttaaatccagcaaaggtctatagaaaaaggcttgcgtgttcgttgagtaatcattgtttcattttcatttttacgagagtttgaaaatagacacactgttaacacttctgccagttttttctgatctttccagccccaccccctttctctttctctctctctctcaaagaaaaaaaaaatgggagtgcaaaaaaaacaaagccaaaaaatatatgaaggatagctgttcttctgtgttctctcattatggactttgtgaagtagaaacataattttttttcctccaaaggtgaaaaaacaatgcattcttgctttaaaaaaaaaaaagaaggctaaaaaattacctctttttaaattatgtgcaaaataattctggctaactgtaaaatgtattcaattttaggattttttttttttgtattgtgatgctttatttgtacatttttttcctttctggatgtaattttaatctcttgccattcattagtgttatttcattgtaaacgttattgtgccaaatgtactgtattcaaaaggatgtgaatgtgtattgtttcagaacctaataaatacaatgacgttaagtcttaaaaaaaaaaaaaaaaaa

SEQ ID NO: 41 - DNA, 5774 bp, Homo sapiens
aagtgagggcggcgatgagagcgaaagttgcgctcggctcgtcgctgggggcttgaagcggctccgcgctctgcccgtttgggcctcccccgactcggactcgcgcccgtgggctcccgccgcgcccgcccggccccgcgccggccccgcgccccctcccccgtctcggcgccccctcctcaggagccgcgggtccccgccactttcgcacggccccggcccccgccgatgccggccatggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtggcggtggcatgagggtcggaccccagtaccaggcggtggtgcccgacttcgaccccgccaaactggcaagacgcagtcaagaacgggacaatcttggcatgttggtctggtcacccaatcaaaatctgtcagaagcaaagttggatgaatacattgccattgccaaagaaaagcatgggtacaacatggaacaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatgcttccagataaatctatagcaagtctggtgaaattttactattcttggaagaagacgaggactaaaactagtgtgatggatcgccatgcccggaaacaaaaacgggagcgggaggagagcgaggatgaactggaagaggcaaatggaaacaatcccattgacattgaggttgatcaaaacaaggaaagcaaaaaggaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacagatccagaatattaaacagacaaacagtgctctcaaagaaaaacttgatggtggaatagaaccatatcgacttccagaggtcattcagaaatgtaatgcacgttggactacagaagagcagcttctcgccgtacaagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggctcctgttctggatgtcagatatgcatctgcctcctgagaaactggtggctttgaacacttggtgtggactactgtgttatccgggatatcaggtattatgagacatcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccagaatcacttttgttatcttatcagaccatgggcctgctgagggttgagcagacagcctgcattctaacataccctgttcccaccccacggccattcagactgcactcaatacgctgaagtcgcttttgttgttgttgttgttgtttgcatcatttggatttttttcctgctttcaataccaaaaaaatgcagatgctttaaggcctaaacagaattctgaagaatttaaaatatgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtttgcacattgcataaagggtacactaaggtatgagctgaagctttaggttctccgtgcttccctcaagacctccttcttgctaacagaagcagtaggcaattgctgcagtgcgtttctcaccctgccaataggtctgtctgtatctctgttaaggaaaatagcctggtccctcctggcagtgcttggaagcttgatgctaatttttatatagcgtggcaaactgaccagcagtgccaggccttgatctgtattctgcactatccctttacttggttcctggcactgaatggtctccagccctgaagaatcacgtgtgatcacagcagctgacctgggctttctccccgagaggaaggggcatgtcatttttatttgacagagggaaaatgggagctgtccttgactgcctttgttgtgctttcccgcgtaagatagcactgtgttttaaactgttgcattacactgtctttgcaatgatgtaaatgtaagaaatcacttagctttaaaagcgcagtggtttgatcttatttatatgaagactttttaacatatcaagaattaggtgcattggcaggtagggtttggggtgtgataactgcttcagatggaatgttcacttaagctttgtcttcttaaaaattatcaatgtgaatgtcataattatatatatttttgtggaaaattttctcctaagtataagttattgtgcaaaatatagtgtcattgatgcaaataatagtttaacttttagtttagaactcctaaaagatataaattgtattgcatatgcattaaaagtttgttttatttaattttatgtagatgtgtgaagtgttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtggagacgccacttcctcaaaatggtttttgattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgtaataaaatatgaaatgaaagcaaaaaaaaaaaaaaaaaaa

SEQ ID NO: 42 - DNA, 8421 bp, Homo sapiens
ttgtcagtcccgcggagccagaggaggcgccggtcgctggcagctgagcggcggaacccttcgctggcgggagcgcggttcggggccgcagaggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagagaatgaaacaagaaacaaatcagaaaatgaaaagaaccgcaatcaggaagacaacaaagtcaaagaccttaaccaagagattgagaaacttaagacacaaatcaaacactttgaatcgttggaagaagagcttaagaaaatgaagtccaaaaataacgaccttcaggataattacctaagtgaacaaaataaaaacaaattattagccagccaactggaggagataaagctacaaatcaagaaacagaaagagttagaaaatggagaggtagaaggggaagatgctttcctgtccagcaaaggcagacatgagaggactaagtttagaggccacggaagtgaagcttctgtgtccaagcacacagcgcgggaactgtctcctcagcataagcgggaacgactccggaacagggagtttgctctcaacaatgaaaactattctctgagcaacaggcaggtttcttctcccagtttcaccaacaggagggcagcaaaagcttctcacatgggggtgagtacagacagtgggactcaggagacaaagaaaactgaagaccggtttgtacccggctcctcccagagcgaagggaagaagtctagggagcagccctcagtgctgagtcgctaccccccggctgctcaggagcacagtaaagcgtggaaggggacttccaagccaggcaccgagagcggactgaagggaaaagtggagaagacaacacgaacgtttagtgacaccacccatggatctgttcccagtgacccattgggtagagctgacaaggcttctgacacctcctctgagactgtctttggcaagaggggacacgtgcttggcaacggaagtcaagtaactcaggctgcaaactctggctgttctaaggccattggagccctggcctcatctcgaagatcctcctcagaagggctctctaaaggcaaaaaggctgccaatggccttgaggctgataacagttgcccgaattccaaggctcctgttctatcgaagtatccttatagctgtagaagccaagagaacatccttcagggattttcaacctcacataaagaaggggttaatcaacctgcagcagttgtgatggaagacagcagtccgcatgaagccttgaggtgtcgagtcatcaaatccagtggcagagagaagccagactcagatgatgacttggacatagcatctcttgttactgccaagttggtaaatacaaccatcactccagagccagagcccaaaccacagcctaactctagagaaaaggctaaaacccgaggggcacctagaacctccctatttgagaatgataaagatgctggaatggagaatgaatctgtgaaatctgtcagagcctccaccaataccatggagctcccagataccaatggtgctggggtaaaaagccaaaggccctttagccccagagaggcgttgcggtctagagccatcatcaaacctgttattgttgataaggatgtgaaaaaaatcatgggaggatctggaacagagactacgttggagaaacagaaacccgtctccaaaccagggccaaacaaagtgacaagtagcattactatatatccatctgacagcagcagccccagagctgctccgggtgaggccctgagggagaggcacacatccactagcaatatccaggtggggctggcagagctcacatcagttagcaaccatgtcagctccccttttgagctctccattcacaaacatgacatcaccctgcagcttgcagaagcggagagaatggcagatgggcccctgaaggacaggccagaaacagtggtctctcggagcagcattataatcaagccatcggatcctgtggagaggaatagccatgcacctccagcggagacaatcaggtggaaaagccatagtgccccttcagaagtgggcttctcagatgccagacatgttactgtgcggaatgcctggaagagtaggcgagacttgaaatctttagaagaccccccaactcgaataggtaaaaacgtggaatctaccaatagcaatgcctacacccagaggtcttccacagacttctcagaactcgaacagcccaggtcctgcctttttgagcagggcactcgaagggtaggaccaagttcaggggatgcccctgagccctcctccagaaggacccaaagtagcctcactgtgtcagaggtgcttacccgtcggaatcgggtaggagacaccatcactgtcgcagcctggaaccactcagcaagcatggaggaagaaggggaagactgtacactcagtgtctacaggcaactgcacaactccctggatccgtctgaactgcctgggaagcaggggctgccagagtctgggcgagtacgggccgaggaacgattacggccaaccaggccctgtgctgaggagaactgagcccgctgggtgtctgttgtctgccctctgctcctgcttctcagctcttccaccgtcctgccccacgaaggatccaaggccagttaaccaggcaagacacaagccttggctggaaaactgtggtagagccgggctgtggctcaggtaatttttgccatttggccagagggaatcagagactacaagctggacagtcacccaggcccaaccttccccaatgcacgagtcctctctctctccttgtccctgtccaccaagtagttggaccattctggcccccaaacaagggaagataaagtccccagcacacagcaggagtcaaaaattcttctcggctccttggtgggttgtttctggatcctagggcagcctctgtctgtgtggttaatgttctggtttctcagtctcctcactatatccacttcactcctcatttgcccaatgggctcaagtaccccataagatttaccagccatcagctctatctagggggctttcatttctttccccttggagttcttttcttcagacttaaagcagaaaggggtctgtgctgcctctaaaggattatgagactaccctttaggttgaagtttgacctggctcctggcttaccagtctcctggaagcagagcatgcagatactcatgcggatacccattggaatgacatcatccctccccaaccccagctctctctgctcaccttccaaaggcacctggaggtgcaagcctcatgcatctcctttcctgagcaccagtaatgctgctggcatcgcctgctttctctccagtggctggagacttcaagctgacttcattgtttccaccttgggaaaatccctaggctaagctgggcctgacccagcatcctctgccttctaggaagtgcccagcaagagggaaagcagacccctttagtcactccacaagcaatagctccatgagaggcatggactgtgagactactccctcctgttcctccttctccatcccccatggaggaggcatcgcactttaccaagctgatgcattcctacagaagtgggccccggatttctgcaagtcgactatcatgatgacttcgctggaggaaaggtgatacgtacatacgcattgagggcctcagctttatatagttcaaaatgcagcaaacttttcagaaagccacgtaaataaattggttaggttccttataccagtcacatggggaagttgaaaagaattgtatattcttggcagtgctttttctttagcattctgtcaattcaaagaagggatcctctttcaaaggctacctttatgaagtagacactattgccctcagaatgagagaacattaaactaccagtctggtaagctggatttttttccccatggctttacttccttgctgtgtgaccttgggtgagtcattgtcttcttggagcctcagtttccctgtctgtaaaatgagttctttgaaatggatgatctctaagggcaccaaatctggtattctaaggttctcctgttttcaccatctataatagtatgggatgatttttgcttgtggaaggtatcatccgtgtgggttcttccctcctgccctcaattgtttttctgggccttgttttttagtttctgtatgttttaatctcatggggatgagctcagagaagctccgtgggcctgtttcccaatctgcaaagtgtgaagggattagatgggatggtctctgaggctctttgtggcatcagccttgcccagtgccacacagtatctcctggcgttctaggagtctaggtattatggaaagtacccaagtctgtgtatctcctgttcctgtgcatctcctatgaatttcctggcaagaggaagactcaagacttcctccagaggaatttgtcttctctgccttcactcagcatgggaaccagtgttcatcctgaccttgtctgtatcagatttggcagtgaggaggcttggggagcacctaccttactttcagggacaggaatctattgctcatacttctgcttcccagagttttgccaatctaaaggcattgtcatgtggcctgcctttcctgtccacatccccacctctgatgctcaagatgctatttccaagatctcttactgctgcttctcctggcttactggccagaaactagctcactcaaggctgccatccttcacttgcagcctccctgccattctccttcactggttggcaaccttgagagttcaaagaaaatcaacctctgtggtggtcaactaaaggtattaggaaactaagtctgtggctcttctctgctgatggaaacagaagggcgccaagccatgcctaaaaagatctcgccaataattcttgtctttgagtgttggagccctggattctggtgctatagctcctggtgccaaagtctggatctttccacatttcagcagcaccaacatctgctgctactcaaaatgtcctgttgaagagggacagctgtgatgcccttttgctggggctgccatcttgaaatctgagtgcaataggatttgcttgtaacagttatttcaggatattttgtttctttaatctgcacactttctagatagattttatttttaagtgtcctcagcattgcagaaaataacattgtaatagcaagtaaaggctggaggctgtttctctgggcttcaaatggctggcaaggctggctctcaaatcccaaagttgggaggcatgtttctgaaaagcaactgaggtgtgactgtttggacccaggcctcatcatcaggggtcctggaggaagcctccaagtagaggggagacctggtagttgaatagttgtttaatcaagccaaatagtcccactgcccccggtcaacaaacccacttttatgacagttttcttccgcagcttggctcttaaattttactggcaggtgtatggttgttggagggttcctagtgagttgggggacctggcaatagagctgcttggttggaggaagtgaagctggcttagtaccagcagctgatctcttccacgtgctgctgctttttttgccactctgatactaaaccagagaaagctgcaggtggataaagaagctgtggctgttttttgcttttgggtggcaatgagaaagagtcacagtgtgggttaaagggatctgcagtggggccaaggatgccaccccaccctcagctgtaggcaagcttgcacataaataacccccgtcagtggagtgttcgggatgcagggggcactatagtgttcttggacttgtcgtcctggggcagttttagttctttatatttagtgggtcagtgccaagtgctaccacttcccaataaaggaatggggacccagaggctgggtccctggctaccttgttatgaggttttgttatttctctgacaagattgctttggaaagagctgcttttagggattattttttgaataccccgagtggggagcagggttctcctcaaagcctcacaaccataggatcataggaaaggggccctattttcctgctgcttcccagctcagaacatatactgaatggaatgtatttttaagagaataaagtctatttttttgtattttaaagattgagagggctaagaaagtagccctcaaataaactgttattgcattataggcccctttgttgggggcagcctgttggtccacacctacttgctcaggcaggtgctctggtctctctcacccctgccccttagagtctaggtgcagcagctccaagcatgggaccaaggaggccagaacctgtcgctggaaaccagggcaaagcagtggctcagggctccttgggtgcatgtgtatcattggagctgcctgtctgcatgtatcctctggcgcgaatgctctctgttggctctgcagtacaatatgtaaccaataaagctccctcgtttccgtatactctgtgcgagtctgtgatgccagttttgtcaatgtcatccctgtgtatcatctgtcttctatgcgttggcgcagctctagtatatttatttatttcattgtgtaatacttaaaattgggtattttacctaaccaattactgatactgcaaggactggaaacattaactgccctgatcctggtgtgcagattctttccattactgccacgaattctaagactagggggggaaaagccttctccgttttcatcttccagtcagatcaccaatatatataatgatgtcccttaactcacagtaagaaagaataaaaccacatttaagggacattacttggatttgcagtaacagtgtttatcatctatctgtcagtcagtcaggagcccctgggaaggaaccagcatgtaacatgtttttatcatcttatatggcaaaagggactttgcagataaggatgctgggatgaggcagaacatcctagatgatccaggtgggccttaaatgtaatcacaggtagtatccttttaagagagagacaaaagatttgactacaggagaaggcaatgtgatgatggaagcagaaactggagttatgtgctctgaggatggaggaaggagccacgagccttcccacacctagaagctgaaaagagcaaggaaatgaactgatcctccctgctctgagagcctctgtaatgaatgcagccctgtgtacccattttagactttaagcttccagaactttcgaatagatttctgtttttttaagagccactaagtttgtggcaatctgttaaaccagctgttacctaagcccttgatcctatgtagtgcgcttcccaaaatgtacaccaccacctttagtagaattgggaagttttagcacatacccatggagggaatcaggaataaaggcagactggtctcccaaaggctcag

SEQ ID NO: 43 - DNA, 4894 bp, Homo sapiens
cgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaatacaaaagctgaaccagcaaacaatattacaagtttcctgtggcaactggcattgcttggctcttgcggctgatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaaagatcgagaatctccatgccatgtaaaactcttacgcacgcaaaaagttgtctatattagttgtggagaagaacacacagcagttctcacaaagagtggaggtgtgtttacctttggcgctggttcctgtgggcaacttggacacgactccatgaatgatgaggttaaccctagaagagttctagagctgatgggtagtgaagtaactcaaattgcttgtggcagacaacataccctagccttcgtgccttcttctggactcatctatgcatttggttgtggagcaagaggtcaattaggaactgggcacacttgtaatgttaagtgcccatctcctgtcaagggttactgggctgcccacagtggccagctttcagcccgagctgatcgctttaaatatcatatcgttaagcagatcttctctggaggagaccagacttttgtactttgctccaaatacgagaattattctcctgctgttgacttcaggactatgaaccaagcacattataccagtttaataaatgatgaaaccatagcagtttggagacaaaaactctcagaacacaacaatgcaaatacaatcaatggtgttgttcagatattatcttctgcagcctgttggaatggaagttttcttgaaaaaaaaattgatgaacattttaaaacgagtcccaaaatccctgggattgacctgaactcaactagggtgttatttgagaagttaatgaactctcagcactccatgattctagaacagattttgaacagttttgaaagttgtctgattccccagttgtcaagctcaccaccagatgttgaagccatgagaatctatttaatactacctgagtttcccctactccaggattccaagtattatataacattgactattcccttggctatggccattcttcggctggatacaaaccccagcaaagtactagataactggtggtctcaggtatgcccgaaatatttcatgaagctggtaaacctctataaaggtgcagtcctttatctactgaggggaagaaagacattcttaattcccgtactgtttaacaattatatcacagcagctctcaaactcttggagaagttatataaggtaaatcttaaagtgaagcatgtggaatatgatacattttacattcctgagatttccaatctcgtggacattcaggaagactacctcatgtggttcttgcatcaagcagggatgaaggctagaccatcaataatacaggatactgtaacactttgttcctaccctttcatctttgatgcccaagccaagaccaaaatgttacagacagatgctgaactacagatgcaggtggcagtcaatggagccaacctgcagaatgtcttcatgcttctcaccctggagcctctgctggccagaagccccttcctggtccttcacgttcgcaggaacaaccttgttggagatgccctaagagagctgagcattcattctgatattgatttgaaaaagcctctcaaagtaatctttgatggtgaagaagcagtggatgccggtggtgttacaaaggaattttttcttttgctgttaaaagaacttttgaatcccatctatggaatgtttacctactatcaagattcaaatctcttgtggttttcagacacgtgttttgtagagcacaactggtttcacttgattggtataacctgtggactagctatctacaactccactgtggtcgatctccacttcccattggctctctacaagaagttactcaatgtaaagcctggcttggaagacttaaaggagttgtcacccactgaaggaaggagtctccaagagcttttagattaccccggggaggatgtggaggagactttctgcctcaacttcacgatctgccgagaaagctatggagtgattgaacagaagaagctgatacctgggggagataatgtaactgtgtgcaaggataacaggcaggaatttgtggatgcttatgtgaattatgtcttccaaatctcagttcatgaatggtacacagccttctctagtggcttcctaaaggtgtgtggtggcaaagtacttgagctcttccagccttcagaactgagggctatgatggtggggaacagcaactacaactgggaagaactggaagagactgccatctacaagggagattactcggccacacatcccactgtaaaactattttgggaaacatttcatgagtttccattggaaaagaagaagaagtttctcttgttcctgacaggcagcgatcggattcccatctacggcatggccagtctgcagattgtcatccagtccacagccagcggggaggagtacttgccggtggcccacacttgctacaaccttcttgacctccccaagtacagcagcaaagagattctgagtgcccggctgacccaggcccttgacaactatgaagggtttagtttggcctgaggcttctcagcttgtccagtatttcccttcgttcctcagtgtccacattgaggcctatacagaaaatcatggggagtgatttctatttttttattgtctaagtgggttgggacttttaaatactgagcctggttgatgtgtttctgggattgtatagcagtaaacaacctttttgaaaaattagaggttggggatggggtgaaaaattggcccttgtatgggaggtgtttttgtttttgttttaaaccaaactacccagtattccttgcacttgtgaatgtgttgcactctgctggatgaaatggcagtggatttttaaactttaatttcccaaatgtctctctcagccctgatgttttctcacagtgcttccttgtccttctcttaacttctcattcctctataagaatgatttagactgacctgtccttttttatctgcgcatgcgagaacatcaccttcctctgtacacttggaaatgcctctggcttgttgcagccctcctttaacccaaaggaggaaaggactgcttcagaaactcccaattccaaaaagctgagtctgggtccattattttggcagaactcctaagaatttatgggagcctatataaacatatcttgcttttaaaaagttcttgagggaatagcaactttcccatggctgtgcctatttcctagaccttttaaaagatgtgcagagcagcttagcattcgttgcagctgagcctaattttttcttgctcatccttgtccctttgacaataaggttaattgatagacccaccacctcttgcactctcgcttttggagcaagttgcattaactattttgagtctctatattgtccaagaaaagtagaaataataaatttactttccctttttctatcaccttatgtcctctaccattttctccttcctcccttcccttattttctccttttcgtaccctgtgtcctccctgattttcctttcgtttcttctttattttatcccattctctgttacttgactcagtgctcccttcctctcctctccttctagtggatgcatgcagcctttttttcaatttttatttaaattgcaaaatttttactcagattttttttcctcttccctaattgctaagatttaaggacgttctttattatgaaactttatcacattcgaaatgtttgtttacagtgggattttaggggggattgtgtttaaatcaaatatatgtattttaaaaataatgacatgctcaaccttcctcatcatggagtaagaaaattctacatgattaaagaatccatgtaagtctaattttaaattcctagtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacaggattaaaaatatatatacagttatatgaaatgtttattttctatgtgtgtgcatatagttcaatattatgcaataaatttggtgttttaactt

SEQ ID NO: 44 - DNA, 6787 bp, Homo sapiens
gtcagcttgggggtgccttcgtcgcgcagccttgcgtcggcccggcccggccaggccagcgggcagatgccccgagctgccgccgccgccgccgccgactcggccggtggcggtgtgggaggtgggcgaccagcccggggccgctgagtgtgacggacgcaactgggggcgccgggggctccgcacggaccatgtattttctgagcggctggcccaagaggctgctgtgccctctggggagcccggccgaggcgcctttccacgttcagtccgacccgcagagggctttcttcgccgtgctggccgcggcccgcctcagcatctggtacagccgacctagtgtgttaattgtaacctacaaggagcctgcaaaatcatctactcagtttggatcctacaagcaagctgaatggaggccagatagtaccatgatagctgtatcaacggcaaatggatacatcttgttttttcatattacatctacaagaggggacaagtacctttatgaaccagtgtatcccaaaggaagtccacaaatgaaggggacaccccattttaaggaagaacagtgtgctccagcattaaatttggagatgaggaaaatactggatttacaagcacccatcatgagtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacggttttcagctattgataagcttggacagaatattgctgtggttggcaagtttggttttgcacattactctttactcaccaaaaaatggaaactttttggaaacattacccaggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactgtgggagagcagctgttaaagtctcaatcagctgacccatttttgaaccttgagatggatgctggcatctccaacatccagcgaagtcagagctggctcagcaacattggccccacccatcatgagatagacacagcttcatcccatggaccacaaatgcaagatgccttcttgtcacctttatctaataaaggtgatgaatgcagtattggttcagccacagacttgactgaaagtagctccatggtggatggcgactggacaatggtggatgaaaatttctctacactcagtttaactcagtcagagctggagcacatttccatggagttggccagtaaagggcctcataaatcccaggtccagcttcggtatttgctacacattttcatggaggcagggtgcctagactggtgcatcgttataggcctgattcttagagaatcctcaataatcaatcagattttggttattacacagtcttcagaggtagatggagagatgttacagaacataaagacagggctccatgcagtggaccgatgggcctctacagactgtcctggatataagccatttttaaacatcattaagccacaactgcagaagctcagtgagataacagaagagcaggtccagccagatgccttccaaccaataactatgggtaagactccagaacagactagcccccgggcagaggagagcaggggctcctccagccatggaagcatcccccagggtgaagttggaagcagcaatatggtcagccggaaagaggaggacacagcccaagcagaggaggaagaaccttttcaggatgggacttacgactgttctgtgtcctaacagtgaggttccatcacaaaggggcagtattaattagcagcagcgtgcagctcagtacgttgtaacatagttggatgatttaacaggagaactcagttcagagactcttcggtaagtattagtagattttaactaattctttcttgtctaagaaatctttttgactccataaaaatgtgatataaagcatctttcataaaaaaattttaagctgcagtgaaaagtaaatattgtacagatgtacatgagaatattttggttttactcaaaggttggtagctcttaaaccacaggaattgttttgccccaggtgagcttactttttcactacttacatcttctcacatttcccggttctgcattatgtccagattgctttttaaaaaataaatgctaaggtgcttgctatagtctgtcaggtacttgagctacctgtttgctcccttggatacagctggactctttaatcagtcctcctgaatagattgctaccctggggcacaatatgtgccagtgtgatggaaacattctccttggctttactagccagtcaaatcccagtccagaattgatggaagctatttacctgtgagttaatgtgcttgttttagcaagcttgattcccattagaccaatgtgggcagaggtctgagggggttcttctcaattttgctgttagataccactaaactattttgtattaaagaacagtatctttttgtgaatactcttgtgtaaatatattcaaaggcactgttcatattttagggcttgtattataatttgcaaggttttaatgctggattctgcatgtctacacatacaaagacagggcttgctcctctgcaaaactgaggaagacaggtttattggcttggtcatgaagtaacagaaatggtcacactgatcatgaaatgcagcaagttttgtgcaaattaacatagtctcttatttattgcttttgtaaattgaataaagatggacttctatgtaaatagactgctgaatcctgtattaccacggctactaaaaattagtgtgtaaagaatgcattcttcattgtaaacttaaagtattttatgtacttctagaaatgacttaaatttgttttcatacattatgaaaacaactgcatactccttaattgctttaaacacccatccactgtatgtaattctaattaccttataacagtattaagacagcttgtttgtactgtgcaatttgaacaaggaatgcaatgttattttttacaaaaaacaaacttgtttatttttataataacgatgtatttgatgtggaccaaattcgtaccactatctaaaatagcctcttttctcatagtgcagttgtagtttagaaacaaaacttggtcctctctccttgctttttaaagtaaatggctagatttagttgtcttagccaggtttcctttgaagagaaactcaaaaccattttgaaactgcttagttcagaatacatcgaagtatttaaaattactgagttgggtaatttactatcatttactttttacattacaagtgcaataatatttcacaaaatgaaactcccgaatgggtggagtatgtgattattggtacctggtccttctggtgctatttttatttaagtctttgtttcaaaccacctttccctgaatcttaaagataatgttttgcatgtgagtacatgcagcccagcaagaaactaaactgaactctcttctcctatcctagtccattaaggagaagaaccagcattgcttttgtgtttggtgtgaatattcagtcaataaaaatgatttaccattataaagagctgtgatcttttcaagtatctgaaataaaacactgtgctgctgagttcatctcaaacattcttgaaagcagggcaccagtataagttaactgtattcctgtgggttaggccgtgaatgaatcatttcttttatacaatattcttttacaactaatagagataggaggcccccaggcaagaagtttggcaggtttacagaaaatttggtaatttatttgttatataccttaatttttaaaaacccatttttattgtggtgtttggttcacatatcaactgtttaagccataattttagccaatgaatttaaatattcagtataactatttgaggtttactagatgcatttattaataaattatttgctgaaaccaaaacaagtcattgggggtgtgggaataaaatcaacctttgcttgtaattaaagttgctgctatttctgtaatgtgtatttttctccccttggtaaagggcaataaaaccattacacaaaaaaaaaaaaaaaa

SEQ ID NO: 45 - DNA, 9256 bp, Homo sapiens
gaggagagggcgcgttagtgagcagcgactgtggcattgatgtttgagcatacttctgaactggcttttgttgagactatcagtatagaagcatgcgctgtcccaaatccgctgttactatgagaaatgaagagctgcttttaagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccctttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaatacttgtttctctctctgcgtgttgtattgttggtagtcattatatgttggtgatacatctgcacacctcactgtttcacgtatctgtttttttctctatgttgtgtaaaaagatacagtcgattccacttaagtgaatatctgatttggggaagaggaaactgcacagcagccacctttgatttatgtacaaccgcccacttgaactcctgcttccaagatttatacacttttttcctacagttcacctcagtaactgcctttggggttggatttgccaaggtgttttacggtcttttgaccacacaggttaatttccccttctctcccctccctcatgagtctatccacgcagttcttaacatacattccaaactgctgcggggtttcctctccacacccacgaggccaaacccgcatcattacagtccaactcttcttagacactaatcactttctaaaagaagtgagttctccagggaagaaaaatcaacttagccagtgaaaagggttaaacttaagtctattatttgttgccctcaatcaaaagatatgtatagaaaagtcatttaaattatttatttctacaagctaattgaatccaggagcagctttaattattaacactaacggaagagaaaagaagtatttccaagggctcaaatggaagctgtactcagtccggtggaggcagggggaggtaaagtttctcacactcaagtcgtcttcatagtttactgtccttttccaaacaaaagctaataacgccatacgcatccacacactccctcctggatgaacctaagtctcgtccccactgtcaccccaaggccagttatcaaaaactgttccttctctgccctcaaagactgaagccgcaggccctgttctgcctctgctcaggaatctgattgctcttaaagtgctcttacaagattccgtcgatgtttgctccctctgtcttatctctccttccagtattttcagacgcacaagctctgactcaggccacccagcacctggcagccttcctctgcgtgccagtgaaatctctcccagtaggtgctcaggctcttcaccctctcgttgcagcagcccctctggcccgagattgtattttctagtctgctcaagaacagaggggcctggcgaggtggaggaagggaggctccctccccggggctggccgcctcagtgatggtgatgccaccagctccagcctgcacggatggagctcacttcctaccatcacttctgctttcagtctcctcatagccttcggcagtctcctctgaaaacacactgcctacgttagtgggaaaggatggctaagggtgtgatttctttttattagggaggtgggagggggatgttgggaggcatggggggtgattaaattatcatttccaaggtgcaagtgtttatttttcaaatctataagtacatagttccaccattttggcacaagacaaaatactcatgctaagcaaaggaagagaaagacaaagccagtttttgttgcttttctaaagcaacaaataattctccaaagaaggggatgaaaatgctagttcctttaagcacttactgactgtaaagttggtccctgcttaaattcatacccatagttttgagtcggtatgacaccactgcagtgtgagcaaggtgaatccgtgtgccatgcatggaccaccttgggataccgcagcaccatcaacatccgccttgctgatggaagccacacacgctgcccagcccacagcagtcgcacgcagccgatgggctcggactcttagctggcaggctaggacacacagtgaacattaatgtactgtgaatcgttcctgataagtgaataaaacattgtgaccaaacaatcagcttattcacttatcaggaatcgactgttctgctaatttgctgttgttgtttttcatctctgttgtagttcactatttttgctgtgttctgttttctcctctcatgcttgggcaaatcactgggaatattatcttcatgtgaccatgaaacgtttctattgagtgaaaatgatatcttaacaaaatctatgcacttgctatcaggaacacaatactggatgtgtcttatatatattgaactatatagtactcgatttcttaaataaagcttaagaaaggactctgttgtgtgtaaagttaatgtgattatttttcaaagcagtgtttctaaggggtatttttgttcttttaagtcttgagtgatacaggatatttttcattaaaattatatcactggctttatgacttaatattcaataaattgactttggaaacaaaaaaaaaaaaaaaa

SEQ ID NO: 46 - DNA, 3155 bp, Homo sapiens
gcaccgaggcgcggagcgcggcgcacggcggtgcccagggccgcgggcgggcaggcgggagcgcggtgggtggccggccttggacgggtatggcggaccggcggcgcgcgtggaacaccgaggacgacctgcccgtgtacctggcgcggccgggcagcgcggcgcagaccccgcgccagaagtacggcggcatgttcgccgcggtggagggcgcctacgagaacaagaccatcgacttcgacgcctacagtgtgggccgccgcggctcggcgcgcacgccgcgcagcgctggccggcccgacgcggtcgggctgccagggccgggaggcagcgaggacacggccagcgacgtgagcgagccctcgggctccgcggtcagctctcccggagagcgcgacgagcggccgccgacgctgcgcatccgccgccccgcgccccgcgacctgcccctcggccgggacaatggccagagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactgacctgactagggcactttcaaaaaaaaaa

SEQ ID NO: 47 - DNA, 3050 bp, Homo sapiens
tttttttgcttctgccccagatctttcctggacagtgcgtctcagcagttcagatccgggggcccccagctgacagagggcgtggggggttaaggcattaacccctcccagcctcttcctgaagaaaccacccagccttggcgcggcgctgggtgacttcgcgtagcaggcagggaactggccgcggcgagcgggactggccattggagtgctccgctgcggagggaggggaccccgactcgagtaagtttgcgagagcactacgcagtcagtcgggggcagcagcaagatgcgaagcgagccgtacagatcccgggctctccgaacgcaacttcgccctgcttgagcgaggctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaagatc

SEQ ID NO: 48 - DNA, 1885 bp, Homo sapiens
cagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaaaaaaaaaaaaaaaaa

SEQ ID NO: 49 - DNA, 1920 bp, Homo sapiens
agcttctgccaagggtgggggcccacgcggaggcgatccgctcgttcctcccagggccatggggcgacgaggagagccctggcctccccgcgacccgcaccgcgacctgggccagacgcgccaccttccccggtcgcggtttgcttctctttaaaatgaggacagctcctcccttgggggctgtggtgacaggtgaaatgagaacgcactgaagacagctcttggtccaaagccccgcacacagggcatggtctagtggcccagtcaggacgcggaaacactccctggaggttctgacccactccctctcagcctccgcctggtctctgggttggctgttccagctccaaagagaaggaggaaccttttccttctgcagcccctccccaccagctccattccttagctggggtcagacctggggtcctcactgcagctggcctctggcagcgttctcaggctagccctccctgctgaaaagagaaccgtgtgggactcacaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctgaaaaaaaaaaaaaaaaa

SEQ ID NO: 50 - DNA, 8305 bp, Homo sapiens
gcgcccaggagcagagccgcgctcgctccactcagctcccagctcccaggactccgctggctcctcgcaagtcctgccgcccagcccgccgggatgcagtccgggccgcggcccccacttccagcccccggcctggccttggctttgaccctgactatgttggccagacttgcatccgcggcttccttcttcggtgagaaccacctggaggtgcctgtggccacggctctgaccgacatagacctgcagctgcagttctccacgtcccagcccgaagccctccttctcctggcagcaggcccagctgaccacctcctgctgcagctctactctggacgcctgcaggtcagacttgttctgggccaggaggagctgaggctgcagactccagcagagacgctgctgagtgactccatcccccacactgtggtgctgactgtcgtagagggctgggccacgttgtcagtcgatgggtttctgaacgcctcctcagcagtcccaggagcccccctagaggtcccctatgggctctttgttgggggcactgggacccttggcctgccctacctgaggggaaccagccgacccctgaggggttgcctccatgcagccaccctcaatggccgcagcctcctccggcctctgacccccgatgtgcatgagggctgtgctgaagagttttctgccagtgatgatgtggccctgggcttctctgggccccactctctggctgccttccctgcctggggcactcaggacgaaggaaccctagagtttacactcaccacacagagccggcaggcacccttggccttccaggcagggggccggcgtggggacttcatctatgtggacatatttgagggccacctgcgggccgtggtggagaagggccagggtaccgtattgctccacaacagtgtgcctgtggccgatgggcagccccatgaggtcagtgtccacatcaatgctcaccggctggaaatctccgtggaccagtaccctacgcatacttcgaaccgaggagtcctcagctacctggagccacggggcagtctccttctcggggggctggatgcagaggcctctcgtcacctccaggaacaccgcctgggcctgacaccagaggccaccaatgcctccctgctgggctgcatggaagacctcagtgtcaatggccagaggcgggggctgcgggaagctttgctgacgcgcaacatggcagccggctgcaggctggaggaggaggagtatgaggacgatgcctatggacattatgaagctttctccaccctggcccctgaggcttggccagccatggagctgcctgagccatgcgtgcctgagccagggctgcctcctgtctttgccaatttcacccagctgctgactatcagcccactggtggtggccgaggggggcacagcctggcttgagtggaggcatgtgcagcccacgctggacctgatggaggctgagctgcgcaaatcccaggtgctgttcagcgtgacccgaggggcacgccatggcgagctcgagctggacatcccgggagcccaggcacgaaaaatgttcaccctcctggacgtggtgaaccgcaaggcccgcttcatccacgatggctctgaggacacctccgaccagctggtgctggaggtgtcggtgacggctcgggtgcccatgccctcatgccttcggaggggccaaacatacctcctgcccatccaggtcaaccctgtcaatgacccaccccacatcatcttcccacatggcagcctcatggtgatcctggaacacacgcagaagccgctggggcctgaggttttccaggcctatgacccggactctgcctgtgagggcctcaccttccaggtccttggcacctcctctggcctccccgtggagcgccgagaccagcctggggagccggcgaccgagttctcctgccgggagttggaggccggcagcctagtctatgtccaccgcggtggtcctgcacaggacttgacgttccgggtcagcgatggactgcaggccagccccccggccacgctgaaggtggtggccatccggccggccatacagatccaccgcagcacagggttgcgactggcccaaggctctgccatgcccatcttgcccgccaacctgtcggtggagaccaatgccgtggggcaggatgtgagcgtgctgttccgcgtcactggggccctgcagtttggggagctgcagaagcagggggcaggtggggtggagggtgctgagtggtgggccacacaggcgttccaccagcgggatgtggagcagggccgcgtgaggtacctgagcactgacccacagcaccacgcttacgacaccgtggagaacctggccctggaggtgcaggtgggccaggagatcctgagcaatctgtccttcccagtgaccatccagagagccactgtgtggatgctgcggctggagccactgcacactcagaacacccagcaggagaccctcaccacagcccacctggaggccaccctggaggaggcaggcccaagccccccaaccttccattatgaggtggttcaggctcccaggaaaggcaaccttcaactacagggcacaaggctgtcagatggccagggcttcacccaggatgacatacaggctggccgggtgacctatggggccacagcacgtgcctcagaggcagtcgaggacaccttccgtttccgtgtcacagctccaccatatttctccccactctataccttccccatccacattggtggtgacccagatgcgcctgtcctcaccaatgtcctcctcgtggtgcctgagggtggtgagggtgtcctctctgctgaccacctctttgtcaagagtctcaacagtgccagctacctctatgaggtcatggagcggccccgccatgggaggttggcttggcgtgggacacaggacaagaccactatggtgacatccttcaccaatgaagacctgttgcgtggccggctggtctaccagcatgatgactccgagaccacagaagatgatatcccatttgttgctacccgccagggcgagagcagtggtgacatggcctgggaggaggtacggggtgtcttccgagtggccatccagcccgtgaatgaccacgcccctgtgcagaccatcagccggatcttccatgtggcccggggtgggcggcggctgctgactacagacgacgtggccttcagcgatgctgactcgggctttgctgacgcccagctggtgcttacccgcaaggacctcctctttggcagtatcgtggccgtagatgagcccacgcggcccatctaccgcttcacccaggaggacctcaggaagaggcgagtactgttcgtgcactcaggggctgaccgtggctggatccagctgcaggtgtccgacgggcaacaccaggccactgcgctgctggaggtgcaggcctcggaaccctacctccgtgtggccaacggctccagccttgtggtccctcaaggaggccagggcaccatcgacacggccgtgctccacctggacaccaacctcgacatccgcagtggggatgaggtccactaccacgtcacagctggccctcgctggggacagctagtccgggctggtcagccagccacagccttctcccagcaggacctgctggatggggccgttctctatagccacaatggcagcctcagcccccgcgacaccatggccttctccgtggaagcagggccagtgcacacggatgccaccctacaagtgaccattgccctagagggcccactggccccactgaagctggtccggcacaagaagatctacgtcttccagggagaggcagctgagatcagaagggaccagctggaggcagcccaggaggcagtgccacctgcagacatcgtattctcagtgaagagcccaccgagtgccggctacctggtgatggtgtcgcgtggcgccttggcagatgagccacccagcctggaccctgtgcagagcttctcccaggaggcagtggacacaggcagggtcctgtacctgcactcccgccctgaggcctggagcgatgccttctcgctggatgtggcctcaggcctgggtgctcccctcgagggcgtccttgtggagctggaggtgctgcccgctgccatcccactagaggcgcaaaacttcagcgtccctgagggtggcagcctcaccctggcccctccactgctccgtgtctccgggccctacttccccactctcctgggcctcagcctgcaggtgctggagccaccccagcatggagccctgcagaaggaggacggacctcaagccaggaccctcagcgccttctcctggagaatggtggaagagcagctgatccgctacgtgcatgacgggagcgagacactgacagacagttttgtcctgatggctaatgcctccgagatggatcgccagagccatcctgtggccttcactgtcactgtcctgcctgtcaatgaccaaccccccatcctcactacaaacacaggcctgcagatgtgggagggggccactgcgcccatccctgcggaggctctgaggagcacggacggcgactctgggtctgaggatctggtctacaccatcgagcagcccagcaacgggcgggtagtgctgcggggggcgccgggcactgaggtgcgcagcttcacgcaggcccagctggacggcgggctcgtgctgttctcacacagaggaaccctggatggaggcttccgcttccgcctctctgacggcgagcacacttcccccggacacttcttccgagtgacggcccagaagcaagtgctcctctcgctgaagggcagccagacactgactgtctgcccagggtccgtccagccactcagcagtcagaccctcagggccagctccagcgcaggcactgacccccagctcctgctctaccgtgtggtgcggggcccccagctaggccggctgttccacgcccagcaggacagcacaggggaggccctggtgaacttcactcaggcagaggtctacgctgggaatattctgtatgagcatgagatgccccccgagcccttttgggaggcccatgataccctagagctccagctgtcctcgccgcctgcccgggacgtggccgccacccttgctgtggctgtgtcttttgaggctgcctgtccccagcgccccagccacctctggaagaacaaaggtctctgggtccccgagggccagcgggccaggatcaccgtggctgctctggatgcctccaatctcttggccagcgttccatcaccccagcgctcagagcatgatgtgctcttccaggtcacacagttccccagccggggccagctgttggtgtccgaggagcccctccatgctgggcagccccacttcctgcagtcccagctggctgcagggcagctagtgtatgcccacggcggtgggggcacccagcaggatggcttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaggcctggcctgggcccagatgctgatcgggccagggacaggcttgcccatgtcccgggccccattgcttccatgcctggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctggcttttccactccaacccaggccaccctttgtctctgccccagagttgagaaaaaaacttcctcccctggttttttagggagatggtatcccctggagtagagggcaagaggagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggttaggctggggctcatcgagggtctcaggccgaggccactgcggtgccagtgcccccctgaggactagggcaggcagctgggggcacttggttccatggagcctggataaacagtgctttggaggctctggacagctgtgtggtgtttgtgtcttaactatgcactgggcccttgtctgcgtcggcttgcatacagagggcccctggggtcggccctccggcctggcctcagccagtgggatggacagggccaggcaggcctctgaacttccacctcctggggcctcccagacctcctgtgcccccacctgtgtgggcaggtgggccagtcttcgggtgatgggaccaaaccccttcagttcagtagagaaaggctaggtcctctacaaagagctgcaagacaaaaattaaaataaatgctccccaccctagaaaaaaaaaaaaaaaa

SEQ ID NO: 51 - DNA, 3196 bp, Homo sapiens
cgcggcgcacttggacttccctctccattcgccagccgcctcgctcccggaccccacggctgcaaactgatctggcgcgcggggaggaggagagcgcaggcgagcgaacccgcgagagagggagagagcgagcgagcaacagcgagagcgagagcgagagagccgggaggcagagggagtagtgaccgccttccggagccgggattcatgcctgtcctcgggaccagcgaaggggactttacggctgagtatgagccaggctgctaggagccaggtacccccacgcctgcagtccccgcgccgtgcccggaatgcgagctgcacgcagggctctcccaagttcccaccgagccgaataaaaagcgtcctcccgcagctctccgccaaagacggacattgactccaggactccacagaatggagcaagaatgagaggaaaaaggccggcagaaaagcatgaactggaggtttgttgagctcctctacttcctgtttatatggggccgtatctcagtgcagccctcccaccaggaaccagctgggacagaccaacatgtctccaaggaatttgattggctcatttcagacagggggcctttccaccactccaggagctacctatcctttgtggaaagacaccgtcaaggatttacaaccagatataaaatatacagggagtttgcccgttggaaggtgaggaacacagccatcgagaggagagatctggtccgccatccagtgcccctcatgccggagtttcaaaggagcatccgcctgcttggcaggagacctaccactcagcagttcatcgataccatcatcaaaaagtacggcacccacctgctcatctcagccacattgggaggggaggaggctttgaccatgtatatggacaaaagtcgcctcgacaggaagtcagggaatgccactcaaagtgttgaagctctgcaccagctcgcatcatcctactttgttgaccgtgatggtaccatgaggaggcttcatgagatccagatatcaactggagcaatcaaggtcacagagacacgcactgggcctctgggctgtaacagctatgacaatctggactctgtgagttccgtccttctgcaaagcacggagagcaaactgcaccttcaaggtcttcagataatctttcctcagtatctgcaagagaagtttgtccagtcggccttgagctatatcatgtgcaatggggagggggagtacctgtgccagaacagccagtgtcgctgccaatgtgccgaggagtttccgcagtgcaactgccccatcacggacatccagatcatggagtacacgctggccaacatggccaagtcttgggccgaagcttataaggacctggagaattcagatgagtttaaatcatttatgaagcgcctccccagcaaccacttcctgaccatcggaagcatccatcagcactggggcaatgactgggacctgcagaaccgctacaagctcctgcagagtgccacggaggcacagagacaaaagatccaacgcactgcccgcaagcttttcggcctcagtgtacgctgtcgccacaatcccaaccaccagctgcctagagagaggacaattcagcagtggcttgcaagggtccagtcactcctctactgtaatgagaatgggttttggggaaccttcctggagagccagcggagctgcgtgtgccacggcagcaccacgctgtgccagcgccccatcccctgcgtgataggcgggaacaacagctgcgccatgtgcagcctggccaacatctccctctgcggctcctgcaacaagggctacaagctgtatcgaggccgctgtgaaccacagaacgtggactcggagcggagcgagcagttcatcagctttgagactgacctggacttccaggacctggagctgaagtacctgctgcagaagatggactcacgcctctacgtccacaccaccttcatcagcaacgagatccgcctcgacaccttctttgaccctcggtggcgcaagcgcatgtccctcactctcaagagcaacaagaaccgcatggacttcatccacatggtgatcggcatgtccatgcgcatctgccagatgcgcaacagcagcctggaccccatgttctttgtctatgtcaacccctttagcgggagccattcggagggctggaacatgcccttcggggaatttggctacccacgctgggagaagatccgtctccaaaacagccagtgctacaactggactcttttgctgggcaatcggtggaaaacatttttcgagacggtccacatctacctacgtagtcggactcggctacctaccctactgcgaaatgagactggccagggccccgtggacctgtcggatccctccaagaggcagttctacatcaagatctcagacgtgcaggtgtttgggtatagcctgaggttcaacgccgacctcctgcgcagtgcagtgcagcaggtcaaccagtcctacacacagggcggccagttctattcctcttcgtcagtgatgctcctcttgttggatattcgggaccgaattaatcgcctggcccctcctgtggccccggggaaaccccagctggacttgttctcctgtatgctgaaacaccgcctgaaactgaccaacagcgagatcatcagggtgaaccacgccttggacctgtacaacacggagatcctcaaacagtcggaccagatgacagccaaactctgctaacccgggactccttgccatggacttttcctgttgttgtacacacacaacagaacaaaatgaagcaaaacaaaacaaaaaaacccacaaaaatttgtaaaatgtaattaatattcaaagaaaaggaggaaaatcttcatttgttggaaatgaaaacgttctagcaactgtataaaagcgttgggcatgtttgttatttctatactcactctgtcatgaagaagggtctcagccttttgtggagcattgagggagttgcttcttaggcctcaggtgctgtattgggggagaagggagaaagcatatgcaatgaattgtaaagatctctgctgtgcaggtgctaagattaaacactaaaaagaaagagagatatatgtaatgtacaactgacactgccatttttcctttttggaggaaatggacatagataaagaagatatttcttcggttaagattt

SEQ ID NO: 52 - DNA, 2423 bp, Homo sapiens
cttggtgtatatagtaaaggccgggcgccgcacgcagacacacactcgccaggacacaggcgcacacacgctcacgcacaaccagcagcggcggcggcgacagcgactcggtgacagcggcgacggcggctcccaccgcggcgcacccccttcaggcggccggcggcgaggccagaccggagagttccagcacactcgaccaccccgcggcttcctggaggcggcggccgcgattgcgaggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccggtgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcactaaaaa

SEQ ID NO: 53 - DNA, 5012 bp, Homo sapiens
cgcgcagcatgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtttctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggatacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggctgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaatggaatcgatgacgggctgcatgctgaggacgaccagctgagggtgtattatatgcagaattacataaacgaagctctcaaagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtctttactggctttcatagcttttctattttttgcttctattatttctctctcccttatattttactactcgaagaaaggcagaagaagttacaaatagttctgaacatttttctattcattcattttgaaataattatgcagacacatcagctgttaaccatttgcacctctaagtgttgtgaaactgtaaatttcatacatttgacttctagaaaacatttttgtggcttatgacagaggttttgaaatgggcataggtgatcgtaaaatattgaataatgcgaatagtgcctgaatttgttctctttttgggtgattaaaaaactgacaggcactataatttctgtaacacactaacaaaagcatgaaaaataggaaccacaccaatgcaacatttgtgcagaaatttgaatgacaagattaggaatattttcttctgcacccacttctaaatttaatgtttttctggaagtagtaattgcaagagttcgaatagaaagttatgtaccaagtaaccatttctcagctgccataataatgcctagtggcttcccctctgtcaaatctagtttcctatggaaaagaagatggcagatacaggagagacgacagagggtcctaggctggaatgttcctttcgaaagcaatgcttctatcaaatactagtattaatttatgtatctggttaatgacatacttggagagcaaattatggaaatgtgtattttatatgatttttgaggtcctgtctaaaccctgtgtccctgagggatctgtctcactggcatcttgttgagggccttgcacataggaaacttttgataagtatctgcggaaaaacaaacatgaatcctgtgatattgggctcttcaggaagcataaagcaattgtgaaatacagtataccgcagtggctctaggtggaggaaaggaggaaaaagtgcttattatgtgcaacattatgattaatctgattatacaccatttttgagcagatcttggaatgaatgacatgacctttccctagagaataaggatgaaataatcactcattctatgaacagtgacactactttctattctttagctgtactgtaatttctttgagttgatagttttacaaattcttaataggttcaaaagcaatctggtctgaataacactggatttgtttctgtgatctctgaggtctattttatgtttttgctgctacttctgtggaagtagctttgaactagttttactttgaactttcacgctgaaacatgctagtgatatctagaaagggctaattaggtctcatcctttaatgccccttaaataagtcttgctgattttcagacagggaagtctctctattacactggagctgttttatagataagtcaatattgtatcaggcaagataaaccaatgtcataacaggcattgccaacctcactgacacagggtcatagtgtataataatatactgtactatataatatatcatctttagaggtatgattttttcatgaaagataagcttttggtaatattcattttaaagtggacttattaaaattggatgctagagaatcaagtttattttatgtatatatttttctgattataagagtaatatatgttcattgtaaaaatttttaaaacacagaaactatatgcaaagaaaaaataaaaattatctataatctcagaacccagaaatagccactattaacatttcctacgtattttattttacatagatcatattgtatatagttagtatctttattaatttttattatgaaactttcctttgtcattattagtcttcaaaagcatgatttttaatagttgttgagtattccaccacaggaatgtatcacaacttaaccgttcccgtttgttagactagtttcttattaatgttgatgaatgttgtttaaaaataattttgttgctacatttactttaatttccttgactgtaaagagaagtaattttgctccttgataaagtattatattaataataaatctgcctgcaactttttgccttctttcataatcataaaaaaa

SEQ ID NO: 54 - DNA, 1970 bp, Homo sapiens
ccaggctgcacggtaggaccggggcgaggggagccaggcggtcagggcggaggccaagcccgggagatgcggttgcagccgccacggctgttggggcgcctggcgctccgtccgaggcgggtggctgtgaggccaggggagtaggcaggctcccagagagattcttccaagttggcgggtggcgggagagggggccgcgcgccccggcgcagctgctttgtgcgcgcagagagggactcgtgtccctggttctctccaaccctgggacccgttgtgcgggcagtattgggcaagccgcagaacggagcgatttcctccgagaaagttgaggatggagcctttttttccgcaccgtccccgcgatggcatgggccccgagaatgctgccccgaggctcccagtgtgggggagctcggggtcgctgcgcctctagcttgagcgcagaaatccgcgaatcactccgatcttcgcgaactctggcatcttctaggaaaatcattactgccaaaactgaggcgagcttttctggcgggcacggcaccctgcccccagggcgctggccctgggcgatgccccctttccgatctcaggcttggtcaagggcgccaggttccgaattcgcgcttgccgtgcacgccggcatcgagcctcaccaacaccgccgggcaacgtggctggagtagattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcggcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaaaaaaaaaaaa

SEQ ID NO: 55 - DNA, 6549 bp, Homo sapiens
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgctggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgacagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcataccttaaaaaaaaaaaaaaaaaa

SEQ ID NO: 56 - DNA, 5018 bp, Homo sapiens
gcccgggactatcccttcgcggtgtagcggcagccggagacctggctgaggaggcaaccgcgtagacacctccctgcttagaaaacaaacactgaaccagaccgatcccagttggagggttcgaaaatgttccagacagcctgtcgggaggggttgttgttgctgttggactaaatagctattcctgattggtcatgtatagggttttttaaggcgggtggggggaggagggggtagaggaaaggctccaaacacctgcaggttgggggcggaaagctgtttgcgattccctggactggttggtcggggacaggaggtaattcccagccattgacccccatttctctctctccctccctcttgccctgcctctttctctccacccctatctttcctggaaactcgctttgggcgcggcagatcgcccaggaccacaccgcagcgtaactgcaggcctctcagcgaaaaagggggaaagcaaagacccgggtgtgcatcctcttcctcggcttccgcccctttccggcggagtggagatcctattcagaggggccggtctctctaaatatgccccaggatgaccgagcggccgccgagcgaggcggctcgcagtgacccccagctagagggacgggacgcggccgaggccagcatggcccccccgcacctggtcctgctgaacggcgtcgccaaggagacgagccgcgcggccgcagcggagcccccagtcatcgaactgggcgcgcgcggaggcccggggggcggccctgccggtgggggcggcgccgcgagagacttaaagggccgcgacgcggcgacggccgaagcgcgccatcgggtgcccaccaccgagctgtgcagacctcccgggcccgccccggcccccgcgcccgcctcggttacagcggagctgcccggcgacggccgcatggtgcagctgagtcctcccgcgctggctgcccccgccgcccccggccgcgcgctgctctacagcctcagccagccgctggcctctctcggcagcgggttctttggggagccggatgccttccctatgttcaccaccaacaatcgagtgaagaggagaccttccccctatgagatggagattactgatggtccccacaccaaagttgtgcggcgtatcttcaccaacagccgggagcgatggcggcagcagaatgtgaacggggcctttgccgagctccgcaagctgatccccacacatcccccggacaagaagctcagcaagaatgagatcctccgcctggccatgaagtatatcaacttcttggccaagctgctcaatgaccaggaggaggagggcacccagcgggccaagactggcaaggaccctgtggtgggggctggtgggggtggaggtgggggagggggcggcgcgcccccagatgacctcctgcaagacgtgctttcccccaactccagctgcggcagctccctggatggggcagccagcccggacagctacacggaggagcccgcgcccaaacacacggcccgcagcctccatcctgccatgctgcctgccgccgatggagccggccctcggtgatgggtctgggccaccaggatcagccaggagggcgttcttaggctgctgggatggtgggcttcagggcaggtggggtgagaattgggcggctctgaagcaaggcggtggacttgaactttcctggatgtctgaactttgggaagcctttactgaccctggggctggcttttctgtttcctgtaccagtaggagatcagaaaaatggagcaaagtggtaggtactttttgtgaagacggcacggtcttccctcttccctcagtcccaaatccttcccaagtaagaggctggagttgtcactgcttttggcctggagtttgggatccctgtctttcctaagacctggggttgtcagctctcatctgaggcatccagcagtctctgccttgcctttagcccctcccaagctggctggggtggcctgtgtggccacttctgtccatatttataggtacccaatagctgcccatttcgtgagccccatcttcacccaggcctatgttgatccatccagcttgccagatgctgcagagtcacaagcctcgaggtgccttcttcagggcctggttgaagaagatgatcagtggacagtctgctctagatgagctgggccggagggtcaggaaacccagtcgcccttacttcttgccctggggatcaaagttctgctttctccccaatgagacttgccttcctaagcctgtggctgtggagacaatgtctgcagccctgagaaagccctgtcgggctttgtgtgaaggcagagaaagggacaatgatagtagagtgatatggagcaagagatattttgggcatgtgggcttcaactcctcgacatcactgttcatgctggcgagtgaatgccagtgtgctgatgggcgtacgctggtgctgagtagatgcgcagccccatctgtgcattctcctggatgcttagagggatttctttgctgtaagatgtctgtttgctgatggtctggtctatgttccgaattgagcacaaaacctgtcctatgaatgctttgcatttggaatttttgcttgacttcagttattggtggaatctttagcgctcaataggaccaggatccagcctcacttctagggtatgggaaatccaatcagagaccaggccctggctaagacccaaacatatgcacattcacttagcagaaccttaaacacccctcagttgtgcagcttttggtcatcaagggtgcgtctgggaggttggtttaatgcaatagaagtgctcccctctgaaagttgtacatgaaatttttgtaaatcacatccttatccttcatcttttaaagaaataaccactgcaagtccttttgtaaagtgaagaatccttttgtagaatgaaccactgccccttcattgatttcctgtgtcaatccagatggtgggatgtggttttcttaaggtgaggcctgtctgtgacctgcatctaagcccatgggacaaattgcacagaagtcctgtatgtctgtcattgtacccttaagtcaccctagccctctccctctaggctctgccttcgaggtcagaggagagatagcctgtggccctgtcctgccatgcaagaactcatcactgtggctgtctggaaagcccccccttatagtttgggcttcagcctagtggcttgtcctcaccatgatggggccctaattcagccatgtacagacagagaatatgtctgctcctttccccttccttttaagtaaggtccaattctcgagcttggggcaacattgttcacctttgtagcactcaggctctccattcaatttcaggctccccagatcatgttttggtgaaaattagggttggttcctttccaacgtttggaagatcctgtgaggagccccatctgtctaaagatagagtcattgctgtaggatctaaggctgtttgcttcaccgtggattcgcttgagttaggaatgagaagtagccacagtatggatgggtggatgggttttatgagatggatcacatattttattaagaactcaaacttctggctccctcttctttcagacttgccatgtgactctggcttggcctatctcctagggctatggtgtggactgaatgggatcatgaaagtagacagttttgagaacgtaaagaactttttcttttccctcaatctcaatcctgcagtggggtttcgcagcctgagtccacgacctaggcagtaggccggtgtgcctgactgcccagcatttgggtaatttagattgtaaaccgctttggcctgagttattgagattgtcctcatttctccagattatctatttgtgtgtgtgtgtgtgtgtgtgtgagagacggtgtcttgttctgtcactcaggctggagtacagtggtgccatcattgctgtctgcagccttgaactctgggctcaagcaatcctctcacctcagcctcccgagtagggaggaccacaggtgtgagccaccacacctggctaatttttacttttttttttttttggtagagatggagtcttgctatattgcccaggctggtcttgaagtcctggcttcaggcaattctcctgcctttgcctccagaagcactgggatcacaggtgtcagccattgcacccagcccagattgtcttaatttctatcttgttccaaggccagggacagtaataagaatggaaaagagatatgggaacactggcagactgtgtaaaatgtaatgcaactacccaaaacaagcctggtaggaaagggcaagtctttaggtctttgtaagaactaaagaagatctgtaatttttattttcaccctctgtaccccatgaccttatccttcctctccttccttgttacccatgaaaaactggcaacattccaagaatagcatctgtacaaaggggaaagaacataaaggtaaaacaaaacaaaacaacattttgagaacaaagatgaccataaccactgaagggaatcacatcttttaagacaaattcatattcttttatttgttatggcagatgacaagatggtacaacctttattcttttccaaaataaaacaaagggcacagcatctgtagtcagccgacaactatttcggccttttgggggtgggtctggccgtacttgtgatttcgatggtacgtgaccctctgctgaagacttgccccctgcccgtgtacatagtgcattgtttctgtgggcgggcccagcactttccgtcaacgttgtactgtatgtgatgaattgcgttggtctctgcatttttctgcagaagaggagtaaccgctccaggtaccttgacctttgtacagcccagaggccaacactgtgggtgtgtgactctttagcaaaaaaaacccatgtggtgatgatgtgtatatatatgtgaggatgtatcgggaagatttctaaataaaagttttacaaaggggaaaaaaaaaaaaaaaa

SEQ ID NO: 57 - DNA, 9479 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggacccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctactaactctggactttgtctgtttattaacctttatatgtttaattaaaataaacaaataaagacaaaagaatgtaaagtcttgagttactggactaaccctgaagaacgtgaccacagataacatagtgtgacttgtttttatgttgtttgtcagctgacagttttgcacactactgttaaaatggctttggttattctggtcttttagcttgggggccggggcgggtgtgggtgtaggtgcagtagagatgggaacaaagtagcctttgtttgaggcattcttctcttgccacttgcctttcagcatctgcattactaattccacaccttatttttccttctccaaaataatcactgtctgctcacagcatcgagtaaaaagatacattgtcatggtatatacctggagaaaccagtttgattctttgttgaaccatttcttttaatttctgtaaataagtaattttatggtcacattgtaaagcagagaaactgttgatattttacctttatttagatttttgttttaacttgacctttttcctttggaaagcgttgaacttgtttagctaactactcctattaggggagcttaacttgggtaaagtcaaaggcccactggctgtttctcatggtggcctgaagccccgctgctttccagtgaggaaaagaaccctcagcacgttactgagctttcctcaggtatttttttctctgtcacctactttacaaatacagtcagactaaaacattaaacaagaagtttaagggggaataacattgggatttgaaaagttgtatgtgattaatttcttgcatgcaaatcaatttaagatttcttaaatatcttcatgcttttcttggctggaacttgggtaaattaacctgtaattatgaattatttagtttaactcaaggtgcatttttatttcacagattgatacttgcttttttctgtgaaacagttctcctagataccaaaatcctcaggatgaatttttgcatttgtaaataacaatttatctttgtaaattacattttatttatttagagttctaaaattgagggctgaaatgaatgacatgtaatagaagacaaaactgtaccaatacgctgttaaccaatcagactgtccaggtattctcatttcataaatatgtatacacacatataaatacacagagtagtgttagctgatgtgagtgataacagcgaatcaccattgagatggtcatttggatcatgtaaacaaaccgtgtcatgtctctgatgggagcggtgggtagtgtactgttaggtggacaggtcttttaacatgctactatttgtaaaagtttccgttgccataacagttcatgtagtagtctgtgaaaattcgaagctgtctgtcaagctgctaatatacaagttgtcatggtaccatgtaacttaaattgatgaatttctatgcaatttactattctctgaagcctatgaatgcagcctcatctcattttcagttaagggtactttatgtataattatgtcattgctgccttttatgtaggaaatgtaaaaaagttttaaaaggcgaaaataacattacagatttcatttttatacaggttacaatattaaacatgaaactaccaaattccaagaatagtaaaattctagagtcagttgattgattgaaactatttgacaaaacagttgaaagctgagctttcagtcaagaagttggtgaaattaatgtccttaaacttttcctttaggcaaaatgtcagggaaaacttaacatgaaagtagttactcccatacgcaccagtgcagtagctccaggtgtaagaggtcacgaaggcaccctgcccataaaaccaggatgtgcatacgtacacacaatcggtgtctggttatggttttctaaacactacataaggatctgaattttttagtgtgccaaaagcaaacgataggtttaaatgaaattgctcactaccaaatcaagactcttcatatatatacgtgtgtgtatatatatatgtcataacactttcacgtgtgacagcctaaggtttctttagttttaggatggggtggggtgggagtggttttgcatgtttgaccaggatgtgatgcctgtctttattccttgataagaagtagctgttacagcatttcaagcaaattattttaggtagaatagaacttactgccaaatgattatttatttagcaaaaattattctccaacttttcgaattcacaatttttctaagtgcatagagtagttttttacattgtcacgaattccttaatacctttatttaaaatggaaaaaatatggacaatattttagaaatatgtgctacacatctaattttatctgtagtttaagtgatctaaattgagatgcctttgatatgaagagatttaccaacattatatgcactcgtgccttcaatgtggaatcaaactggttaacctcagcacagtcctctcgtttctgtgtttctgctgcactaattgccagggggtgggggagaaggcgaatgaattaattcatagtagaaggaggcgataggtgcagcaaagggcagccacagtgttgattccacattataatgttgttgcctcttcttggcaaaagacaccacattgtgggaagatctcagcttccagggtaaaagttaatttataacttaaaagtgctattaagtttttattaccaaatatatcttttatggtttatattgtagtggtatgtatgaaacatttaaaattttactgtggaaattgtgtatatatatatatatagtcgaaataggtgttcacaggtcacatgtgaacggagaactgcatgaccgtacatgaaatgcaataaaccaactggaaaaagtgcatgtgcttcatcctctcaagccaactgcagctggaaagtgctgcttatcctccacccccagaaaatgcatgtatcaatatgagaataaagaacgcacactttcaattttattgaggctttcaacactatttaaaagaaaatgtaagaatttgacattctggagttattataacattagaaaatgagcataacattcactctgattttagccattaagggagattagtaaacagactgctacagtgttccatagttggactgtgcatccaaaacatttttttatctttaataaatggtacagtttttatgtagttttcgaatgtaagaagaaaggaatgctgaccaaaacttgatttcatcagcttcatgaaaaggactagtgtcattaacctgttgaacagaattggtttattaaaaaaatcatttccagtagtgtgaaacctttacgagtctttaacatctaaatgttatgactccttgtaccttaagttttccagtctttcttatttatatcatctccaagtacctctggctcctttcctcttgctcaccggaaccttagttttcctcaacagaatgctttgttaaagtagcccacagttgcaggatccatagcaccgtcgtgcagactagcagcccaaaggtgtgtttggtttggcttatacggtgttttgctttttaaactacttgccataatttaaaagtggcaacactagacttaaaaaaaaaaaagtctgattgcccatattagattttttttttaattcttcacaaaatctgctcttcctgaaagatcaaagtgtctagaaagcccaaacatgtattcttaacatagtaggcaccagctgaaactgagtaattaaacggtcccctgaagccaagtattccctggttagtcgccaccccaccactccttcctgtctctagtgtcacacttgggctgttgattttcttactcttctcttgctttaatccttccccccggctctctggctcctgtggatatctgtgcttgtttcctggtccaggatggtgatctgactttcaaaccagcttctcaaaaggggtgacataaaatcagttttgatgtttttcctcctgaaaaatcagatgaatattttagtcactgttactcatgcacattgtgttcttatgtttacagaagtgcttaagtgaatggaagcactagacatttggatttccttcctaacgtaatttttaatgattaccccttttatacagtaatttgtggtctttagaaagcagttaaactaattgaccatctaatagttgtactatacatatgtctaaaataatagtcatggtaagtttggcatcatatcttccccaaaaaatgtttattaaaattagattattccagtttaatgctattttgtgaactgtataccctctgaaagcgcttatttttacatgctacacaacagttccaattttaaggagtgtctcctaaaattgggatgaaaatctactgtagtctgttttaaagtatgctatactatgttcattggttacttaactggatattaatataaaggttattacaagaaaaatgatgaagagcaaaaggagaagaaaatatttgcaagtgaatccacaattcttgcagaactatttgagttgatactaaagattttatgttcactcctttaccttagaactgtcaagcttgggaatgaggaaagtgccttggctgtgcttgaaacctgaattttagtgcttcccttattacattcattgttttcaatgattgatttataaaattaagacatactggtagtacaagttgaaagttggtttgaatacattttaattaaatgataatatgttaatatgcttttgttcattgctttctcactgaggtaaaacagcattaaaaagttgtccagaatttaaactgaaaaaaaaaaaaaaaaa

SEQ ID NO: 58 - DNA, 5595 bp, Homo sapiens
cgggggacgcgggggacgcgggggacggcggggaacggcgggggacggcggggaacagcgggggacggcggggaacagcgggggacggcggggaacagcaggggactgcgggtcgcgtcctggccgccgaggagctccttcccttaacagagctgagagaggcatctggagctgcagcatggaccagcgagagcccctgcctcccgctcctgcagaaaatgaaatgaaatatgataccaataataatgaagaggaagagggagaacagttcgattttgacagtggagatgaaatcccagaagcggacagacaggccccatccgcccctgagacaggaggtgctggagccagtgaagcccctgcacccacaggaggtgaggatggagctggagcagaaaccaccccagtggcagagcctactaagctggtgctcccgatgaaagtcaacccatattctgtcatcgacatcacgccattccaggaggaccagccgcccacccccgtgcccagcgctgaggaggagaatgtgggtctccatgtgccctgcgggtacttggtgcctgtaccctgcggctatgcggtgccctccaacctgcccctcctgctgcccgcctactccagcccggtcatcatctgcgccacgtccctggacgaagaagaaacaccagaagtcacagaagatcgccagcccaattctctgagttccgaggagcctccaaccagtgaagatcaagtcggtcgagaggacagcgcacttgcccgctgggccgcagacccggccaacacagcctggatggagaatccagaggaagcaatttacgatgacgttccaagggaaaactcagactctgaaccagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaactttctcatgacctaacccgtttaaaggagcactatgagaaaaagatgagagatttgatggcaagcacggtgggcgtggtggagattcagcagctcaggcagaagcatgaactgaagatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagattgaatgtgctgcttataaccctgaaccttacctaaataatgaaagccagccagattcattttccacggcacatggtttcctgtggatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatatgaatactaaatgttaaacttcatcagcgtcagacctattgtatcatattagagaatttgcagactaagaatttatgagaaaatatatgtattcagtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcaggcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttattttaaaatgcaaaaa

SEQ ID NO: 59 - DNA, 1185 bp, Homo sapiens
ggcctccaccgccttccccggctgcccggcagcctcccctcgctcgctctcctcttcctctagggccccagcgcagctcgggagcccgcgcaccgaggcgctaggggcaccgcgcactagagggacacccgccgcgcctggacagcccccggcgggcgcccccctcgcacctcctgccccgcgcgggccgcgctcccctcccccgcgcctgtgtccccagggcgcagggccgcgcgtccagccccagacccgccggggtccctggggacgcgccagcccggcagtggctcgacgatggaggagccgcagcgcgcccgctcgcacacagtcaccaccaccgccagctccttcgcagagaacttctccaccagcagcagcagcttcgcctacgaccgggagttcctccgcaccctgcccggcttcctcatcgtggccgagatcgttctggggctgctggtatggacgcttattgctggaactgagtacttccgggtccccgcatttggctgggtcatgtttgtagctgtattttactgggtcctcaccgtcttcttcctcattatctacataacaatgacctacaccaggattccccaggtgccctggacaacagtgggcctgtgctttaacggcagtgccttcgtcttgtacctctctgccgctgttgtagatgcatcttccgtctcccctgagagggacagtcacaacttcaacagctgggcggcctcatcgttctttgccttcctggtcaccatctgctacgctggaaatacatatttcagttttatagcatggagatccaggaccatacagtgatttaccattttgataattaaaaggaaaaaaaaaggaagactctcactgtaaaaacagctgtaggtataatgtatattcccagagaattgtatttaactaattaatgttttttatattcttaaatttgctcacaaattgtggtttgttacaattaaactggatacttatttgcaaagtgttgtagcttataatgaactcttaagtatcttattaatgtattaatgtcttcatagatcatattttcttagacaatgtttaaatagataaattgctaatattgagaatgtgtcaagtttgtaaacctaacttttaagatgccagattcttttttgattaaatgttgcaaaatcccaaaaaaaaaaaaaaaaa

SEQ ID NO: 60 - DNA, 2579 bp, Homo sapiens
gcagagcagcggcggcagcggcggcggcggcagcagccacccgatgtcttcggcgcccgagaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccagcgagttcatgttcgaggagggctcctttcggcggcggccgcgcggcttccgaaggaaatgccaggcgctcaagcccatgtacagcatgatgaacgggctcggcttcaaccacctcccggacacctacggcttccagggctcggccggcggcctctcgtgcccgcccaacagcctggcgctggagggcggcctgggcatgatgaacggccacttgccgggcaacgtggacggcatggccctgcccagccactcggtgccccacctgccttccaacggcggccactcgtacatgggcggctgcggcggcgcggcggccggcgagtacccgcaccacgacagctcggtgcccgcctccccgctgctgcccaccggcgccggtggggtcatggagccgcacgccgtctactcgggctcggcggcggcctggccgccctcggcgtccgcggcgctcaacagcggcgcctcttatatcaagcagcagcccctgtccccctgtaaccccgcggccaaccccctgtccggcagcctctccacgcactccctggagcagccgtatctgcaccagaacagccacaacgccccagccgagctgcaaggcatcccgcggtatcactcgcagtcgcccagcatgtgtgaccgaaaggagtttgtcttctctttcaacgccatggcgtcctcttccatgcactcggccggcgggggctcctactaccaccagcaggtcacctaccaagacatcaagccttgcgtgatgtgaggctgccgccgcaggccctcctggtgcaggcaggcgggtcacagggaccctggaccggcacaagaaactgctttcttctcgaggtataaccgtcggcagaagaaaagggttccacctctccccaaccggagtttttggcaaggagtccccaatgcaaagacacagcgctgcggttggcacctccttcctcactccttcaaaattgttaagaaatgttagtggtgggtctgatctgactgcagccatcggtaaataaaagtttttgatcctgttgaacccgcctgagacggtgctgtgcaggggaaagcccccgcacccacacaggaattctgctgaggtcccccctccttccggccaatggcagaagtgggggaaaatttttagaagaaaagcaaacatgtgagaccaatcattatcaaatacttttattttttggttgagtatttatctttttattttttattttttttttgaaagaatgtcttggaatgcgcaagtctccctttagagccgtcttttgcagggagcgggaagtgacaagagctcagatctccctcccgatctccctccccacctccgaagtctcctccgtggaccacaggtggatctttgtgcgaacaacttgcatttcggaagccactgtccgtctttaaacagaaagtcaaaggagccacgaagcaagcggccgtccgggcgtccgcctccgtccccttccatgttcctcctcttccttcgcttcagcctcttctgttatgttttgtcttgaattttatttagactttttcagtgggtatttttctgtctcccaacctctactgtaaactttctggtccgagaacgagccgaacacagcgcgacgcagggactaggacggcccggtgaccgcgcggattcaggattgcggggacgcagaaaggttaaggcacttttaaaaactatagcaaggctcctgtttatttattctactttctttccctaataatcaaaacaccgcgtaggctcctccgtttatcagtattaatggtgtaactttgttggcaatatttgccgtgtagaattttttttagatatccattgtaaatttgaaacaaagaccgatctgtgtaaaaacaaatttccatatgttttatataaatatatatataatatgaaggactaccctccttttttttttttgtattttggctgctagagtgcagcatttgtgacacgtatttgaaatttgaaatttccttctgcactgtataaaaggaccatttgaggatgttttgccttttgtgtattttttcctaaaaaaagaacaaaaataaaaatgtataacatttgtacatggcctttaaaattgtatcaactagaaataaaattgcatgagtattttaaaaaaaaaaaaaaaaaa

SEQ ID NO: 61 - DNA, 2430 bp, Homo sapiens
ctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctaggcttcagaaaccggaacaacagcactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtctccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccagcactgtcagttctgctatctctgcccgctggtctgcgaaacggtctgcgctccaggaagctacgttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccgaaaaaaaaaaaaaaaaaaaaaaaaaaaaaaaaaaaaaaaaaaaaaaaa

SEQ ID NO: 62 - DNA, 5844 bp, Homo sapiens
agtctggggcgggcgctcgggctgcgcgggctctgggcagcagcagcagcagcagcagcatcctctcttcctttacttcccttccgcttctttctcttccttctccttctttttcccccccctccccttcttcccctaacccttctacccctctcctttttctccggagggcgctaagtccgtgagcggtggcagtcgcgaccgcgggtgcatccagtttctgcgcccagattttattgatctaatccaaagtatcttataacttctggctggaattaagattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctaattctaccttgtcaaagattcctgctttacagggtagcacaaagtccccaagatacagctcagcctgccctagcacgactaaaagggctacattttctgacagtttattaatacagcccacctcagcaggctccacagaccgtttgccatactcaaaatcagggaacaaggacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggttaggattttaaacaagaagatcgattttagcaaagttcagtccagatgtggttccaaggataacatcaaacattcggctgggggcggaaatgtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacct

SEQ ID NO: 63 - DNA, 2723 bp, Homo sapiens
ggacaaactgttccagatgggagttggagaaagccttgctatggatgtgacatttgggctgagatgtggatgatgagaaggagtcaggcagccgtgccctggaggagatagcgatgcagacagcagaagccctgaggacagagccagctgacagcccatgtggtgccagaggggagaactggagaagttaaatcagtccacggatgatatcaacagacgggagactgaacttgaggtccagtaggtgtttgcagatcccttcttaagcctcaactgtgtttcctcggtttcccctggctgcaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaagttaaaaaaaaaaaaaaaaa

SEQ ID NO: 64 - DNA, 5873 bp, Homo sapiens
gaaaaatgcttcctgtttctttaaaggcgctcgcggctcgggcggcccgggctggggaggcggtggcggcgggagctgcctcctctccgggcggcggcgctgactgatctcgcgaactgggcttctgtgtaaactgaggctaaacaaacacagatggagcgcagcgggcgttctccagaaatgctggcaaggaggcagcgacttcagatgacactctgagcgctccgggaacggacagcccggcggcttcccgaagccggcggcgcagctgcccggggcgagggggagaaagggagagagggagggggagggcgggcgaagcgggagagccagagactcctcggcgctgagcgcggcggcggcccgggcagccccacgcccctgcctcgcgcgccgcccgcgccatgaagcacatcccggtcctcgaggacgggccgtggaagaccgtgtgcgtgaaggagctgaacggccttaagaagctcaagcggaaaggcaaggagccggcgcggcgcgcgaacggctataaaactttccgactggacttggaagcgcccgagccccgcgccgtagccaccaacgggctgcgggacaggacccatcggctgcagccggtcccggtaccggtgccggtgccagtcccagtggcgccggccgttcccccaagagggggcacggacacagccggggagcgcgggggctctcgggcgcccgaggtctccgacgcgcggaaacgctgcttcgccctaggcgcagtggggccaggactccccacgccgccgccgccgccgcctcctgcgccccagagccaggcacctgggggcccagaggcacagcctttccgggagccgggtctgcgtcctcgcatcttgctgtgcgcaccgcccgcgcgccccgcgccgtcagcacccccagcaccgccagcgcccccggagtccactgtgcgccctgcgcccccgacgcgccccggggaaagttcctactcgtcaatttcacacgtaatttacaataaccaccaggattcctccgcgtcgcctaggaaacgaccgggcgaagcgactgccgcctcctccgagatcaaagccctgcagcagacccggaggctcctggcgaacgccagggagcggacgcgggtgcacaccatcagcgcagccttcgaggcgctcaggaagcaggtgccgtgctactcatatgggcagaagctgtccaaactggccatcctgaggatcgcctgtaactacatcctgtccctggcgcggctggctgaccttgactacagtgccgaccacagcaacctcagcttctccgagtgtgtgcagcgctgcacccgcaccctgcaggccgagggacgtgccaagaagcgcaaggagtgactggctgcaggcaagaccaaggccaccactgtgggccctccttccagtcaggcctgaggacaaggtgagctcgctgagtccagcctcgtggtcttctccaagatgccgccagatgcccagcctacagcctctcagggtcggatcggagcacgcctgcctccctctcccctccgccctcacccagccaatccgaggctgcttcgcactttgccctctgcctggtggggaggggagagctcagcccccgactcactcagaccccaaggcccactgtccagctgcagaaattcgttgccaaagattggacagagacaccgaaggaaatggggtggtgaaaccccacagcgaaaagccacaccgttgctctgtgacttttgctcctcctgttgcctgagccccatctcaagccaaagatgagtcagtggttctgctaggaactcatggaatggatgggcatttgatgacccctgggggtcatcttggccctctgacctggtgctctctctccactgggccttgtgctggctgagtgcaagacaagccttaggggctgtgagagggaggctggggtgcctgggcggggctgggagtgggacctgagatccctgcccactctctccccttcattggctgcccaggccactggccccagttctcagtgtcccttgggtccaggctccttgggccctaagcatcaccagaagggagtaagcagggagagaagcaatattactccctcccctacaccagggacttgccccagggcagctacctatgggtctttgcttccccagccagcctctcctcactgtgacccacccccatgggcccccgtcccaggcagccagcaccatgggcaggccctgccatggacagaaaaagagtttttctcttgttcagcctgcacgtggcctgaggaaggagtagaggctgggttggctggagccgtcctactgggcaagatggcgccccacttggagggcggtggtctgttacagggtgtgcaggggcagagaaggaagggaccaggggactgggccagtatgtggaggatggggcctgcgtgttcaaagccaaggcccgccccttccttgtgctcaaatggccaaagctgttcacgtctgtgctcaaccatctgcttcaaattgaagtaaaagccccaaaatgtcaagaaaatacttgtgttgagtggactctgtgggtgaccaggactttggccggtcatcagctggggagtgtgagggagggggttggtttctacctacaggttgagagcccttcaggatcaggcgctgtccgagtgagagtgtgtgtgtctgtgtgtggaagggggtggagggcggttcccacagtagtctcagcctggactagtgaccaggaggcctggtcaggaacacatgaggagccctctctgtccgcactgcactcaatctgtaccatggatttatgagataggggcccctattattaaccccgtttcacagatggggtaactgaggcctcaagtagacagggtcagtcggtgacagagccagtcatcgaatcaggatgggctcacttcaaatcctgtgctctcaaaccttttccagccccatcaccagtcccagcccaaagtctcttgtgtggccttgtcacattgcttcacctcagcgggcctaaggtagggacaataaaggcccattgggactgggggaaggggtgataagataaaaaataggagagcactgtcaaggcagaagggacagggctggccaaggaaagggggataggaggggaccggaggctgcagccatacaggacacagtttgtcccttggtttcaccagtgtcactttctcgtctctgctgctcagactcctgggctgggctggggctggctgcagggagccccccttgcagtagcgtttctcaggctggccctttaccaaggaccacagtgtccatgctgtcttggatccctaggctggcacagaaacaggggacccaggtggccctgagcactcctcagagcaaaggtgctctggaagcagactggacagagtgggcatggaatggggccaggagggtctgttaggaaggttcagccaccctgtgaagctggcacagataacagcactgctctgttgtccctcggagcctctgagtaaccctgatggcacttcctaaggcagcaggacatgtggactgaccagcatcaaactgttgacatagaagaccatttctattaccaaagggagtgtaccccattctgctgccaagggagcaaacccatggccttaccacccagaaagagcccatcctccacctcccatccccctcctgcatacatacttcattacatgtttccctttcattctgaagcatcattgatgaccagctgcctgtcagacactaagataggcagtgggaatgaagagatggatcttgtgtcatgcatggcatcacggagctctgggttctgtacggagggtgggacagacaggtagacaagcaaataattatgattatagcagatgactaaggtgttgtcgggagcttcaggaaaggaagaactaactcttggggaggttctcaggaaggatttccctggaaagtagccatgggacttgcgtcttaaatggtgagtaaaagctttctgagcaggggagtaggaaaagggctttctatgcagaggagcactcagcgctggcaggaaattggaatcacccaaggagattattaaatattaaatattgatatgaagtattgatgcccaatttcatctccagaaattctgatgtattggtctagggtgttgcctggtcattgggatttttacaagctcctcaagtgatcttaatgtgcaggcaaggttgaagccgctggtctaagtggggtctggtctacgataagaaagtgactttgagccatcgatttgggagacaggctctgggtggatgtgtgtgtgtgcacacatatgtatgtatgtggatgactaaaagtgcatgctctcctctcctttcccagcttcctctccagcacagcaacttgtgttcgtatgcacacacatgcatactctctctcatgggcacatgcatacccacacacacactcgtgtacatttccagaaaatggaattacatttcagatagattcagattccaacggcagtcttctaaacacttttatgcaagcagccattcaaggagaccctcagcaaaatataaatgacgaggagctgccctcatggggccctgtgaaagcactttgcagtccagccttgggtttgtggtcacagagtcacctgtggatgtttgtagcacactctccttgtcttgtctgctctgggtcaccaggcacaggccataaagggatgagggggccctctccagggacccgcaagatcttcctgggtatgtctgcatgaagccccacgtgtgcacacccatcttcatgtgtgtgtgtgccagcctcctgctctctgcagaacaaaaccagaaggaatggctctgggagttggagatctcagctcacaggccaagctttgcaagactctccaaagactgcccacagactgtgctgcttcctgggtctggcctgagactatcccagaagagagggttaaattctggaggtgaggttttgagcaagtgttcatccccccacactatgctccttcctgtctccatggccacatccttcaaggctctgtgctgttctctttttttctggatttctccacctccaccaagttcccctttctcacagctagtggaggcatgagtaggcaggtcccaggggctgggaactgggtagcattgccatgtgcagggactgtgttgggagctgcaggtacagagctcctctgtgctcaagagcttgccggtgagcctggacggaggcataggtgcagctaattaggataagacaggggccgcgctgtggtcagccgtgggaagccggcgaggggactggagttggggctacacttgcctccctcctatgctgcttcctgagccacgaagtggtcattgccagcatcccaggcaacaaacagcaagactcagacatctccaaggaaaccctttgagtggatctgtaccgttgttctcgtcttgctctcttgctgccctgccaccttcacagctgctttctgtttcctggttccaggaagacagcggggcacagggtccctgctttgtgaggagcagctggcttctccctttgcccccaggttttgccctcccacatgtctcccttctggtgacccggaccccagacaaactatgcctgcctccctgaagccaggcatcctgaggaacttgatagacaaacaatgacagtgttttccagaactgtgggtacgtgtctaatctcagatggtactatgaattcctggagatcaaagtttggatctaattcaacccctgatcctcgaaacggctttcttgcaaagtgtatatattggtttctttgctgaatgaatgaataaaacatggaaaatgtggtaattcaaaaaaaaaaa

SEQ ID NO: 65 - DNA, 4029 bp, Homo sapiens
gagttgcggcgcctggtgtctcagagaggcttgaggttcgggtagtcggtgacatggcggaggccgcggcgctggtgtggattcgcggccctggcttcgggtgcaaggcggtgcggtgtgcctcgggtcggtgcaccgtccgggattttatccaccggcactgccaagatcagaatgttccagtggaaaacttctttgtgaaatgcaatggagcactcattaacaccagtgacacagtgcagcatggagctgtttatagtttggaacccagactttgcggtggaaaaggaggttttggatctatgctccgagcacttggtgctcagattgagaagacaaccaatcgagaagcttgtcgggatctcagtggaaggagactacgcgatgtcaatcatgaaaaagcaatggctgaatgggtaaaacaacaagccgagcgagaggctgaaaaggagcagaagcggctggagcgactgcagcggaagcttgtagaacccaagcactgcttcaccagccccgactaccagcagcagtgccatgagatggctgagcgtctggaggattccgtcctcaaaggtatgcaggctgcctccagcaagatggtttcagcagaaatcagtgagaatcggaaacggcaatggcctactaaatctcaaacagacagaggagccagtgcgggaaagaggagatgcttctggttgggcatggagggactagagactgcagaagggtccaactctgagagttcagatgatgacagtgaagaagcaccaagcacttcaggaatgggtttccatgctccaaaaattggtagcaatggtgtcgagatggcagccaaatttcccagtggttctcagagggcgagagtagtgaatacagaccatggatcaccagaacaactgcagatcccggtgactgactctgggaggcatattttagaagactcatgtgctgagctgggggagtccaaagagcacatggaaagcaggatggttacagaaacagaagagacccaggagaagaaggcagagagtaaagaacccatagaagaggagcccactggggctggactgaataaggataaagagacagaagaaaggactgatggggaaagagttgctgaggtagcacctgaagaaagggaaaacgttgccgttgccaaactgcaggaaagccagccaggaaacgcagttattgataaggaaactatagatttattggcgttcacctctgttgcagaactggagttgctgggtttggagaagctcaaatgtgaactgatggcccttggactgaaatgtgggggcactctgcaggagcgggcagcaagactcttctctgtcagaggactggcaaaggagcaaattgacccggctttatttgccaagcctttgaaagggaagaaaaaatgagtatcatcagagctgattcctatttgtttatagtgtctaccatttacaacctgcataatgtggactcttgaccagtattcctgttgatattaaaagctaactttttagtaacccaattctaactatcccctttttccttgtcagggctgtagaattaatgtctgaaaccatctgggccttaaattttctttgtctggttttctatagtgtatttaataaatatagggctattcacattttttggtttgatcttggtgtcatttaggtaatgaatctatccaagaaatctatccttttgacccaggttatcaaatttgtagacataaggttatttataatggtcccttcttacccttttaatgtctttaggagctgtgttgataatttccttttcattatgatactggtaatttctgttctcactttcctaatcaggttgggtaggggtttatcagttttactgatctgactttttattttattttattttttttgagacagtcttacactgtctcccaggctggagtgcagtggcgcgatctcggcttactgcaagctctgccttccgggttcatgccattctcctgcctcagcctccccagtagctgggactacaggctcccaccaccacgcccggctaattttttatatttttagtggagactgggtttcactgtgttagccaggatggtctcgatctctttacctcgtggtccacccgcctcagcctcccagagtgctgggattacaggcgtgagccaccgtgcctggccgacgatataacttttaaagaaccaacctttggttttatttttctcaattgtttatataattaatttctgttattttctttcttctatttagcttgagtctcctttgatcttttttctttagttccttaagataagccttaggtcattgatcttagacgttatttaaaatacatatttaaagctatacattttcttttaagcattactttagttgcgactttacaattttattatgtcgtatttttattattcagttctaattttcttttttttttctttttgagatggaatttcgcttttgttgcccaggctagagtgcaatggtacgatctcagctcactgcaacctctgcctcctgggttcaagcgattctcctgcctcagcctcctcagtagctgggattacaggctccagccaccatacctggctgatttttgtatttttagtagagatggggtttcaccacattggccaggctggtctcgaactcctgacctcaggtgatccacccactttggcctcccaaagtgctgggattacaggtgtgagccaccatgcccagcctctgattattttctaatttcctccctcagttcttctttgacccatggattatcagaagtgggttgtctgatcagcaaacatttgttttttttcctcttaatatcttcttgttgctgatttctactttaattccattgaggtcagaaaatatcctctttatgatttcaatcctcttagttttattgagactcgttttatgacccaatatgttgtctgtcatggtgagtgtaccatacacagtttaaaagaatgcgtattttaggccaggtgtggtggctcatgcctgtaatccagcatgagattacatgctgagattacagctgtaatctgtaatttgagaggctgaggtgggaggatcatttcgagaccagcctgggcaatgtatagtgagaccatgtctctaagaaaaacaatatgtaatttgaattgttgggttaatatgttttgtaatatcgatgagattaagtggttgatagtattgttcagatcttctatgtctttactgatccttttgtttatttctatcaggtgctgagaaaggatgttaaaatcttcaattatgattgtggaattgtctatttcttaaattctaccagtttttgtatgaagctctaataacttatgtcttcctaatgtattgaccattttatcattatgaaatttccctctgtctctggtaatttgggtttgaaatctactttatcttatgtgaatatagccactgcagccttcttaagcttagtgtttgcacagtatacctctttctattaatttactttgtgcttctgtgcctatttaaagtagtttctttaaacaacatatacttgagacttgcatttttatctgttctctctgtatcttttaataagtttaacattaaatgtaattattaataggtttctaatttacatgtttcctgtttagataagattattttataattgtattttaatttattggctctttagctatactgttttaataatttttttaagttggatgttctagtgattacaatatacattcttaatttttcagtctacctagagttgatgtgccacttcacataaaatgtagaaatcttgtaagtatgtacatccatttatcatacctgtcttttatgctgtagttgtcatacatattaaatctacatatttaaatattgtaagtcctgtcataagttacaatttctgctttaaataatgatatgtattttaaagaaattaagaggaaaaaataaaatcttttgtatttattcacataaaaaaaaaaaaaaaaaaaaa

SEQ ID NO: 66 - DNA, 5901 bp, Homo sapiens
aatgcccccgccgggcggctgagggggcggagcctcagccgctgtggatggggagtggaggcggaggggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaggtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccattttgtatttttttaagtagaaactgagtagtttggatttttatggctcacatctttttactgaagccagaaaggcacctcaaagatgtctcaagctcagcagtcaccgtcatgttgtgatgaagaaagcgaatcaccaggtggtgatttgctatctatttgagaactagaatcactcaacactcattttgaattatgcagaagtggttcatgcagatttttattccagatgaacatgttttaaaagtgcctgaaatatgactgccatatgaatgtgattctgcagcaaaaaacacaaaatagatcatttaattacagaaaatgagatcctctgtgaattctgaatgttaaaaaccaacactgcttttaatcctcttttaatgttttaatacaagctttgtgttctgaaacaaggctgcataagtagaatgggaatccttctaaaggtgggtgtgaactcaccacaagctgagctttatagagcccttgagaaaccctcctgagcactaagcagttggggtgctgattttcttgtacttttgaaaaattaagtcactcccagtttcctgcataagttcttgaacagaatgaaatcacatctccattcaaaaaatgtctcaagcatctactgttgtgtaaggaacttctgattctgattgctgttacttgaataggaaatggttactcattctgtataaaagttttgcaagagaatgaattttttattctgtaatcaaaaagcaataacttgaaattcactctgtaatattataggtcagtcagaattatacaagttttaccaaattgttacacttattctccaagctgccagaacctggtatctgtatctgtaaaaccaaattaacttttgcttaaatgggaagtatacatatatctgtatagatacattacccctttacatgtttaacatacacacacttaaacacataaatactagtgtgattatatctttggagtttgcaatatagcataaaggacaagtagaactgcacattaagattacctaccgaagcaactagatgtggctgggacacaatcaaaggaggaattttgtccacaggaaggtgaggaaattccaaatgaagcctagatcttcagtatcataaaaaggcagagctggccaggcacagtggctcatgcctgtaatcttatcactttgggaggctgagatgggaggatctcttgagaccaggtgttcaagaccagcctcatcaacatagtgagaccccatctctattaaaaaaataaataggcagagctaaactaaccccagtgtcacaaaactcaactggtcatataaatgagtgaaacaggcctctcacacaagcgatgtaaaacagctgggagcagtgggagctgtggcaaactaaagtgcccaagccgcatttaaaaagggcatctgttcagctccatctgcttgctgcggtgcaagaatgctaaaccaggattaccagttcttcacattttttgaaatccaaattttcatgagaaacattctcatttttaaatatcaagaagtgattttaaaatgtttaaatggtgctggttaaacaaacacgtctgcagctggatttagcttgcaagctgccaagttgcaacctctttcattctagaaacttctgtcattttcatcatagcaagtctatgcggacaaaagcctccaaactttccaactgtgtaggccagtacagctggcaaggttcatagaatataatggctatccccctctgccaaataagactatccacaacccagctcagacacagtggttatatgattttgtgtccatacaggagaggccttggtgtcttcacatacattctctgagccaacatctatccagcagccctgacctcctgctataatttaagtctatttccttttaatctaataagagttgatagtaaaaaggcaggtgatggaaatcagtgtataaatcacaatggagtatattggcaactccacagcttatagtttgataaaggcaaatacatgaaaaataaaaatgctactaatgccccaaggtgtctatcaaaatgatgtagggggtatcttaaactgtccaaggcaatcatgcattgaactttattcctatgcagagccaaaacgaatagtgttgataaaatagctaaactttctaaactggagaggaggctacagtgccagagagttattgtctcttttgctttaaatggtaatcttaaaagttgcattgtgctcttcctttgttttgggatagatatatatagagagagatactataaggaagtttatttcttaggaagtgcactgaataatgtatttcttttacagtgtaatatgggggtggggatatgcgaaagaaatgtgtatttttgctagttgcctaccttctgagataaataagcacaatcttgcaatggatccaataacccagttaggtattatagattagtatttaagtttgctgtagattgtgtgtgtgtgtgctaagtaaaagttccatgattcacaattttagtattaacccatgttgcaaaagctgttactggccaacagattgtaatgatgtgtaccatataacacaagcattaactaggcattaacgtttgtaaagccaaatataccatgcagaagtcttcatttttatagcagactgcattaaaacaagttaaatcttgctgtttggggggaaatagtcttgtttgtacaaagtgaaaaatggcacaatttgggcatattttgttgggaagagggggtggtgtagagggagcacttgactgtggctttgacaaaacaaatgaagtcaatgacccatccaggttagactccataaggaactaagacattgattttctttagagtcttagagctggaaaaagcctttacaataatccagtctgtgattttttaaaccttttggtggttctggacctttttgagaatcttagaaaagccatggagtttatccctagaaaaatgaatatgcctatatgcaaaatttgtttgatggcttcataggatccaaagaccctgaagccatccatggctcatgtatttctgcttaagaaagcataatcttgttctgctctctcattttacaaatgattaatgcatcccttttcaactactccagcgctgttgctgctgcaatgttagcaaatgcaagccagagagaagcacttgaaaatcctttgatgtctaaaaaatgttcaaatagtgtggatgtttacatatctgaagttttcagcatttaagcaaattaatgatcatttcaacaaatactagcatatccggtttcccttaatagcctgtcagcagtgctgccttgtcaatttgtgtgtgtgtgtgtgtatgtgtgtgtgtgtgtgaattcataaggagtgcttctgatgcttagtccttgaaatggaacttcaactgtctttcaaaacactggcttcaaaataggatgtgttttcctaatgaatcagaagtgggcaatgagcattgttccacaggaataatttttaatttaatttctataaaactagttgagaaatgagagcctgtccacccaccatttgtgtatcagtggccaattcattagtaaaaataaaggaggggaaaggagaa

SEQ ID NO: 67 - DNA, 5723 bp, Homo sapiens
cggcgaacagacgttctttctcctccatgcagttacacaaaaggagggctacggaaactaaaagtttcggggcctctggctcggtgtgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagtaaaaaaaaaaaaaaaaaa

SEQ ID NO: 68 - DNA, 3185 bp, Homo sapiens
attttcccagcttactagtggaaaagcagcttctttcccacagttccagcaaaagccccagggctgatgctcattggcccaggttggggcatgtgaccattggcaagactcccattggccaggcctggggcaggtgctcactactggagccagagcggagtataagccctacccaatcactgaactacgtgggtcaagagtaaaggagctgtggcttccccccaatcagaagggcactggatgatggatgaactctgtgtggtgcgtcttcacactgacaccaggaggataaggaagtgactccctcagctgagtggctggcatgtgccaggctagagcagcttggctatggcagaacatccagccccaccgtgtggacggcagagatgaggaaactggtgtggggttgccggggccagcaaccacttttctaaagccaaagacgcagaaggtgctgccagtccaacgcttcctccatggaggccttcacccacccacacccatctaagagttcccaagacctgttttttctggctattcctagacagccatcacccccactcacatgtcttccacaagggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttggattggcaaaaaaaaaaaaaaaaaa

SEQ ID NO: 69 - DNA, 2964 bp, Homo sapiens
ctcagcccggacccaggatggcggaggccaataacccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggatccttgcaaaaaaaaaaaaaaaaaa

SEQ ID NO: 70 - DNA, 1674 bp, Homo sapiens
ggggcggggcgtgccggggcggggcgtagtacggactgggcctggcctggggcgtccccgcgaagcctgggcctgtcaggcggttccgtccgggtctcggccaccgtcgagttccgtcgagttccgtcccggccctgctcacagcagcgccctcggagcgcccagcacctgcggccggccaggcagcgcgatcctgcggcgtctggccatcccgaatgctatggccgccgtcgccgtcttgcgggccttcggggcaagtgggcccatgtgtctccggcgcggcccctgggcccagctccccgcccgcttctgcagccgggacccggccggggcggggcggcgggagtcggagccgcggcccaccagcgcgcggcagctggacggcataaggaacatcgtcttgagcaatcccaagaagaggaacacgttgtcacttgcaatgctgaaatctctccaaagtgacattcttcatgacgctgacagcaacgatctgaaagtcattatcatctcggctgaggggcctgtgttttcttctgggcatgacttaaaggagctgacagaggagcaaggccgtgattaccatgccgaagtatttcagacctgttccaaggtcatgatgcacatccggaaccaccccgtccccgtcattgccatggtcaatggcctggccacggctgccggctgtcaactggttgccagctgcgacattgccgtggcgagcgacaagtcctcttttgccactcctggggtgaacgtcgggctcttctgttctacccctggggttgccttggcaagagcagtgcctagaaaggtggccttggagatgctctttactggtgagcccatttctgcccaggaggccctgctccacgggctgcttagcaaggtggtgccagaggcggagctgcaggaggagaccatgcggatcgctaggaagatcgcatcgctgagccgtccggtggtgtccctgggcaaagccaccttctacaagcagctgccccaggacctggggacggcttactacctcacctcccaggccatggtggacaacctggccctgcgggacgggcaggagggcatcacggccttcctccagaagagaaaacctgtctggtcacacgagccagtgtgagtggaggcagaggagtgaggcccacgggcagcgcccaggagcccaccttcccctctggcccagccaccactgcctctcagcttcaacaggtgacaggctgctttcgtgacttgatattggtgtcatagcatttggcctacattaaaagccacaatttcatggggaaaggacaaaatggagagtgactgaggtgctgacctcagtgcaaggctggtgaaccctgcagcgggccagctatggtgggaagcctggcatttggggtgctccttgcaacgtcttaagcaagcgacccccctgacatagcaaaaggtggcaacccatggaggcagaaagaaggacgccagcctgacccttatctgaaacgtcctaagcagagttaatcctggctgctcaggagaggcgacacatttcaaatctccacgagatattctccacacagaaaatcttcttgattctatagagacttaatcatgcctatggctttgaataatcttatgtgatttaaataaattaaatctttataaaaaaaaaaaaaaaaaaaa

SEQ ID NO: 71 - DNA, 2862 bp, Homo sapiens
gcaccacgccgcccgggcttctggggtgttccccaaccacggcccagccctgccacaccccccgcccccggcctccgcagctcggcatgggcgcgggggtgctcgtcctgggcgcctccgagcccggtaacctgtcgtcggccgcaccgctccccgacggcgcggccaccgcggcgcggctgctggtgcccgcgtcgccgcccgcctcgttgctgcctcccgccagcgaaagccccgagccgctgtctcagcagtggacagcgggcatgggtctgctgatggcgctcatcgtgctgctcatcgtggcgggcaatgtgctggtgatcgtggccatcgccaagacgccgcggctgcagacgctcaccaacctcttcatcatgtccctggccagcgccgacctggtcatggggctgctggtggtgccgttcggggccaccatcgtggtgtggggccgctgggagtacggctccttcttctgcgagctgtggacctcagtggacgtgctgtgcgtgacggccagcatcgagaccctgtgtgtcattgccctggaccgctacctcgccatcacctcgcccttccgctaccagagcctgctgacgcgcgcgcgggcgcggggcctcgtgtgcaccgtgtgggccatctcggccctggtgtccttcctgcccatcctcatgcactggtggcgggcggagagcgacgaggcgcgccgctgctacaacgaccccaagtgctgcgacttcgtcaccaaccgggcctacgccatcgcctcgtccgtagtctccttctacgtgcccctgtgcatcatggccttcgtgtacctgcgggtgttccgcgaggcccagaagcaggtgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggtaagcggcggccctcgcgcctcgtggccctgcgcgagcagaaggcgctcaagacgctgggcatcatcatgggcgtcttcacgctctgctggctgcccttcttcctggccaacgtggtgaaggccttccaccgcgagctggtgcccgaccgcctcttcgtcttcttcaactggctgggctacgccaactcggccttcaaccccatcatctactgccgcagccccgacttccgcaaggccttccagggactgctctgctgcgcgcgcagggctgcccgccggcgccacgcgacccacggagaccggccgcgcgcctcgggctgtctggcccggcccggacccccgccatcgcccggggccgcctcggacgacgacgacgacgatgtcgtcggggccacgccgcccgcgcgcctgctggagccctgggccggctgcaacggcggggcggcggcggacagcgactcgagcctggacgagccgtgccgccccggcttcgcctcggaatccaaggtgtagggcccggcgcggggcgcggactccgggcacggcttcccaggggaacgaggagatctgtgtttacttaagaccgatagcaggtgaactcgaagcccacaatcctcgtctgaatcatccgaggcaaagagaaaagccacggaccgttgcacaaaaaggaaagtttgggaagggatgggagagtggcttgctgatgttccttgttgttttttttttcttttcttttctttcttcttcttttttttttttttttttttttctgtttgtggtccggccttcttttgtgtgtgcgtgtgatgcatctttagatttttttcccccaccaggtggtttttgacactctctgagaggaccggagtggaagatgggtgggttaggggaagggagaagcattaggaggggattaaaatcgatcatcgtggctcccatccctttcccgggaacaggaacacactaccagccagagagaggagaatgacagtttgtcaagacatatttccttttgctttccagagaaatttcattttaatttctaagtaatgatttctgctgttatgaaagcaaagagaaaggatggaggcaaaataaaaaaaaatcacgtttcaagaaatgttaagctcttcttggaacaagccccaccttgctttccttgtgtagggcaaacccgctgtcccccgcgcgcctgggtggtcaggctgagggatttctacctcacactgtgcatttgcacagcagatagaaagacttgtttatattaaacagcttatttatgtatcaatattagttggaaggaccaggcgcagagcctctctctgtgacatgtgactctgtcaattgaagacaggacattaaaagagagcgagagagagaaacagttcagattactgcacatgtggataaaaacaaaaacaaaaaaaaggagtggttcaaaatgccatttttgcacagtgttaggaattacaaaatccacagaagatgttacttgcacaaaaagaaattaaatattttttaaagggagaggggctgggcagatcttaaataaaattcaaactctacttctgttgtctagtatgttattgagctaatgattcattgggaaaatacctttttatactcctttatcatggtactgtaactgtatccatattataaatataattatcttaaggattttttatttttttttatgtccaagtgcccacgtgaatttgctggtgaaagttagcacttgtgtgtaaattctacttcctcttgtgtgttttaccaagtatttatactctggtgcaactaactactgtgtgaggaattggtccatgtgcaataaataccaatgaagcacaatcaa

SEQ ID NO: 72 - DNA, 5392 bp, Homo sapiens
actcactccccctccacccagagagcaggacggaggtgtgaacttgagccagaccagaaggagctcgagagcggccgcaggacaagcccgaggagcaggcgggcgctccaggggaaaaccacgcacaaaaccttcttcagagaaaagggaagctccaaacctgactgagacaaacggaggctcttgaaataaaaagaaaataccgcaggacaaacagcctcccgtccccgggcgcaggtcgcggtcacagtggtgacctgggattgctttcccaggactgcgagtcgggtttgggtttctcctccctgcattccacagctgctctggtcatcgcaacgtgtttattgatcactgaagaatctcaagttttgagacgaggaagaaacacccattaggtctccaagacagctgtgtttcacaaactttaaggagacagaaattttctcccctggaacctgtgaaaatgtcccttttccaaggaagtgaaggttaagaggtcccgttctcacagaccctcaggaatttcacttggctccgagctttgacctccgagagagccatggaaaagctgctgcggctgtgctgctggtactcctggctgctgctattttattacaactttcaggtgcgtggcgtctactccagatcgcaggaccatccaggatttcaggtgttggcgtctgcttcccattactggccactggagaatgtggatgggatccatgaacttcaggatacaactggagatattgtggaagggaaggtcaacaaaggcatttacctgaaagaggaaaagggagtcacgcttctctattacggcaggtacaacagctcctgcatcagcaagccagagcagtgtggccctgaaggggtcacgttttcttttttctggaagacacaaggagaacagtctagaccaatcccttctgcgtatgggggacaggtcatctccaatgggttcaaagtctgctccagcggtggcagaggctctgtggagctgtatacgcgggacaattccatgacatgggaggcctccttcagccccccaggcccctattggactcatgtcctatttacatggaaatccaaggagggcctgaaagtctacgtcaacgggaccctgagcacctctgatccgagtggaaaagtgtctcgtgactatggagagtccaacgtcaacctcgtgatagggtctgagcaggaccaggccaagtgttatgagaacggtgctttcgatgagttcatcatctgggagcgggctctgactccggatgagatcgccatgtacttcactgctgccattggaaagcatgctttattgtcttcaacgctgccaagcctcttcatgacatccacagcaagccccgtgatgcccacagatgcctaccatcccatcataaccaacctgacagaagagagaaaaaccttccaaagtcccggagtgatactgagttacctccaaaatgtatccctcagcttacccagtaagtccctctcggagcagacagccttgaatctcaccaagaccttcttaaaagccgtgggagagatccttctactgcctggttggattgctctgtcagaggacagcgccgtggtactgagtctcatcgacactattgacaccgtcatgggccatgtatcctccaacctgcacggcagcacgccccaggtcaccgtggagggctcctctgccatggcagagttttccgtggccaaaatcctgcccaagaccgtgaattcctcccattaccgcttcccggcccacgggcagagcttcatccagatcccccacgaggccttccacaggcacgcctggagcaccgtcgtgggtctgctgtaccacagcatgcactactacctgaacaacatctggcccgcccacaccaagatcgcggaggccatgcatcaccaggactgcctgctgttcgccaccagccacctgatttccctggaggtgtccccaccacccaccctgtctcagaacctgtcgggctctccactcattacggtccacctcaagcacagattgacacgtaagcagcacagtgaggccaccaacagcagcaaccgagtcttcgtgtactgcgccttcctggacttcagctccggagaaggggtctggtcgaaccacggctgtgcgctcacgagaggaaacctcacctactccgtctgccgctgcactcacctcaccaactttgccatcctcatgcaggtggtcccgctggagcttgcacgcggacaccaggtggcgctgtcgtctatcagctatgtgggctgctccctctccgtgctctgcctggtggccacgctggtcaccttcgccgtgctgtcctccgtgagcaccatccggaaccagcgctaccacatccacgccaacctgtccttcgccgtgctggtggcccaggtcctgctgctcattagtttccgcctcgagccgggcacgaccccctgccaagtgatggccgtgctcctacactacttcttcctgagtgccttcgcatggatgctggtggaggggctgcacctctacagcatggtgatcaaggtctttgggtcggaggacagcaagcaccgttactactatgggatgggatggggttttcctcttctgatctgcatcatttcactgtcatttgccatggacagttacggaacaagcaacaattgctggctgtcgttggcgagtggcgccatctgggcctttgtagcccctgccctgtttgtcatcgtggtcaacattggcatcctcatcgctgtgaccagagtcatctcacagatcagcgccgacaactacaagatccatggagaccccagtgccttcaagttgacagccaaggcagtggccgtgctgctgcccatcctgggtacctcgtgggtctttggcgtgcttgctgtcaacggttgtgctgtggttttccagtacatgtttgccacgctcaactccctgcagggactgttcatattcctctttcattgtctcctgaattcagaggtgagagccgccttcaagcacaaaaccaaggtctggtcgctcacgagcagctctgcccgcacctccaacgcgaagcccttccactcggacctcatgaatgggacccggccaggcatggcctccaccaagctcagcccttgggacaagagcagccactctgcccaccgcgtcgacctgtcagccgtgtgagccgggaggctgccaaccaggccaggctgcgctcagaacacacccccccaaacagaatgaaatgccccacctttgcccatggaccctctccttgctgctgtctggacatgggtgttgtggccccgagacagctgtcctcccctgtgactctggctgtcggagcacactgctcagcccagcagcctgatgcccaggccagcgtgggccctcctgccttgcatccacccgtgggctgagtgacttcctcgggggattcccaggacacagtggcctgactgtgatggtgcccttgagcctcccttcatcactcagcatcagacccagcgaggccaggacactcggggccggtcccgcagcaccaggaggggatgttcagcctctgtgccttggtggggcttggggactcagggccaaagaggtggttcaggtccccacgcaccctcagtcaggcgcaggcagctgggggtgtgtggggaagagcatgcggagtccccagtgtctgaatccactgagtggtgagttccccacagccggcgctagccgtggtgtgtgtctctgtaggtggtgccggcgtgggccaacctgtgctgtgtcatcagttgggggcccctgcccaagccgagctcgagccgtgggcgggagtcgttgactctccaggtgagggcgacccctctgccctgtccttgggggggtcccctctgctcacgtgaagagccgctctgggccttgaggctgcctgatggtgcctgtgcttgggggagcttctcggccatccgctgtgagttttgcctctttggaccccaattcggccttaagatgccctcctccctcgtgtgccagcctccttggttgttcttgggccacaggagctggccgtgtccccgcagtgcctggtgtccaggtggaaagtggagggcattttccagggcactgctttccccagaggcttcctcatggctcacaggcactctacgaagtttctaatgggcagaccacgcggcaggtagcacagtgcgctccgtctggtcaccatgagaccgacctgcgctgagtccccactgacctggagagggagggctggtgacagccgtgtcttctgtgttgagggaaatttatggactcagattcagccccagaggagatgggataattgttatggacccatgtgtgggcatgatcctgtggaacacaggtttgggatcatagatgtgaattaagacaccaccgagatacgggctgtgaggttcatactgtgctgatagcactcgtggtgtctgtgaaatgtgggtaagacattcaaacctggttttgatactggaaactcttcctttaaaactgtgaccatgatttcattcagcccctccacacccctatgtctgccttgtttcagagtgagttttctatggagcctgtggcccttttgcagcccacctggtggcttcttaatgtaactcttcccctggtcgcctggagtggaccactcatctgcaggcctctcctgcatggggagggtaggcagggagcagcatgtctgcaggggtgaacctttgctcttctgtcaggcgaggcccaggctgcaccagccacctgccacatggtgacagtgccacgggccctgcgtatggcccctgcaaccgtgctctggcgggcacacctggctgctgcaggccaaggccgctgttcagtgaagagtcccatgtttagtatggactaaagtcccatgtttagccactgccccaggctcccgtgaccccagaaaccaggtcacatggaccacagtgccagatcctcatcacgccggtgagcacctagaagtgagaacactgtattcctacaatgtacacttggatatttctccttatttagtttctagtgaaacaaatcaagtaaggaactatctttagtttagatggaattatttgtttttaattgttgccgtattcatctatatagctaatatttcaagataagtaatgaacaaaacctgtctaaaccttttgtttccaatgaatgaaagtcatgcactttatttataggctctatgttttggcttctgcagtacttttattatctatacataatttggccaaaaataagaaattggaaagaatgaaatgtttagtttatagtagaagaaagatgatgacactaagttgtgaaaatatgttgtgatttttatgaaataaactcatgtcctgaaaaaaaaaa

SEQ ID NO: 73 - DNA, 6052 bp, Homo sapiens
cagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgcacaaaaagctttaaacaagttaaaatctaggcaacagactccctgaagtgttgactgcccaacttaatcatgactgtgattcaaaaatgttaataaataaaccaaggtgtagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtttttgtcaagcaggaaaggatttgcgtttggtatcactgtgtatggaacaaattgacatcccagcaggattcctcctggtgggggccaagtctcccaatctgcctgaacacatcctagtttgtgctgtggacaagcgatttctaccagatgatcatggaaaaaatgcacttttagggttttctggaaattgtatcggctgtggagaaagaggatttcgatatttcacggaattttccaaccacattaacttgaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagccccttttatctgccccagttccacagaccccactaactggaattttacaacccaggcccattcctgcaggggaaactgtaattgttcctgaaaacctgctgagtaactcaggagttagaccagtaattctgataggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtcctgatcaggtacctctcagggaagaatttgagcaaattatgctgaaagctatgcaagaatttactctgagagaaagagccctgcagataggtgctcagtgtgtccctgtgtcaccaggacaactcccctggcttgctagattaattgccagcgtatctcaagacttggttcatgtggttgtgacccagaactctttggcggagggcatttcagagaccttaaggactctcagtgaaatgagacactatcaaaggctgccagattatgtggtggtaatttgtgcatcgaaaatcagaggaaatgaattttgtgtggtagtgttaggtcagcaccagtcccgagctctggcagagagcatgctcaccacaagtgagtttttgaaagaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagctaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcaggtgtccttgtagacttgggtctggaggaaaatgggacagcccatcagagagcagaaaaatatgttgttcgtctagacaatgagattcaaaccaagtttgaagtttttatgaggagagtgaaacagaacccgtacacactgtttgtgctagttcatgacaactcccatgtggaactaacgagtgtcatttcaggctctttgtcacatagcgaacccagtcatgggctagctgatagagtcattaattgcagagaagttctggaagctttcaacctcctggtgctccaggtcagctccttcccatacactctgcagacccaacagtcccgcattagctctagcaatgaggttcactggatacagctggatactggggaggacgtgggctgcgaggagaagctgtactttggcttgagtgagtacagcaagtctctgcagtgggggatcacgagcccacttctgagatgtgacgagacttttgaaaaaatggtgaacacactcttggagaggtaccccaggctgcacagcatggtcgtccgctgctatcttctcatccagcagtactctgaggccctgatggctctcaccaccatggcgtcactccgcgaccacagcacaccagaaacactcagcattatggatgacctcatcagctccccaggcaaaaacaaaagtgggaggggacacatgctcattatcagggtgccctcggtgcagctggcgatgttagccaaggagcggctacaggaggtgcgcgacaaactgggtctgcagtatcggtttgagatcatccttgggaacccggccaccgaactcagtgttgcaactcactttgtggcgcgattaaagagttggagaggaaatgaaccagaagagtggatccctcggacataccaagatttagacggtctaccttgtattgtgatattaactggcaaagatcctcttggagaaacctttcccaggtctttgaagtactgtgacctccggttaattgactcaagctatttaactcgcacggccttggagcaggaggtgggtctggcatgctgctatgtctcaaaagaggtcatccggggacccactgttgccctggacctcagcgggaaggagcaggagagagctgctgtcagtgagaatgactccgatgagctgctcatcgacctggagcggccccagagcaacagcagcgctgtcacagggacctcgggttccatcatggagaatggagtgagctcttccagcacagctgacaagtcccagaagcagtccctgacccccagctttcagagcccagccaccagcttggggctggatgaaggggtctccgccagctcagctggagccggagccggggagactctgaagcaggaatgtgactccctgggcccccagatggcgagcagcaccacctccaagccgtcatcatcatcctcaggacccaggaccctcccatggccgggacagcccatcagaggctgccggggcccacaggcagccctgccaccagtggtgatcctatccaaagcggcctacagtctcctgggctcccagaagagtggcaagctgccatcctcctcctccctgctgccccacgccgacgtggcctgggtgagctccctgcggccactcctgaacaaggacatgagcagtgaggagcagtccctctactacaggcagtggaccttggcccggcagcaccacgctgactatagcaaccagctggacccggcctctggcacccgaaacttccacccccgacggctcctgctgacagggcccccacaggtgggaaagacgggctcctatttacagttcctcaggatcctcttccgcatgctcatcaggctcctggaggtggacgtgtatgatgaggaggagatcaacaccgatcacaatgaaagcagtgaagtgagccagtcagagggagagccctggcctgacatcgagagcttcagtaaaatgccttttgatgtcagtgtgcatgaccccaagtacagtttgatgagcctggtgtatactgagaagctggcaggggtcaaacaagaagtgataaaggaatccaaagttgaagagcccaggaaacgggaaactgtatccataatgctgaccaaatatgcagcctataacacctttcaccactgtgaacagtgccgccagtacatggacttcacctctgcctcccagatgtctgactccacccttcatgccttcacattctcttcttctatgctgggagaagaggttcagctctatttcatcattcccaaatccaaagagagtcattttgtcttcagcaagcagggcaagcacctggagagcatgcggctgcccctggtttcagacaagaatttgaatgcagtcaagagccctattttcactccttccagtggtcgacatgagcacggactcctaaaccttttccacgccatggagggcatcagccaccttcacctcctggtggtcaaagagtatgagatgcctctgtaccgcaagtactggcccaaccacatcatgctggtgcttcccggcatgttcaataatgcaggcgtgggtgctgccaggttcctcatcaaggagctatcatatcacaacctagaattggagagaaaccgcctggaggagctaggcattaaacgccagtgtgtctggcctttcatcgtcatgatggatgactcatgtgtcctatggaacattcacagtgttcaggagccatccagccagcccatggaagtaggagtttccagtaagaatgtgtccttgaagactgtcttgcagcacattgaagccacaccaaaaattgtccactatgcaatcttgggcatacagaaatggagcagcaagctgacttctcagagcctaaaggccccattctctaggtgtcacgtgcatgatttcattctcctcaacacagacttgactcagaatgtgcagtatgacttcaacaggtatttctgtgaagatgctgactttaatctgagaacaaacagtagtggcctgctcatctgccgctttaataacttcagtctcatgaagaaacatgttcaggttggagggcaaagggactttatcattaaaccaaagatcatggtgtcagagagcttagcacccatcttgccccttcaatacatctgtgctcccgacagtgaacacacactactggcagcccctgcacagtttctcctggagaaattccttcagcacgcctcatataaactcttccccaaagccatccataacttcaggagtcctgtgctggccattgactgctaccttaacattggaccagaggtggccatatgctatatcagctccagaccccactccagcaatgtcaactgtgaaggggtgtttttcagtggactccttttgtacctctgtgactcttttgtaggtgctgatcttaagaaatttaaatttctaaaaggtgctacactgtgtgtcatctgccaagacagaagttccttgcgccaaacaattgtccgcttagagctagaagatgagtggcagttccgcctccgggacgagtttcaaactgctaacagcagtgatgacaagcctctctactttcttactggacgtcatgtatgagcttttgaa

SEQ ID NO: 74 - DNA, 3026 bp, Homo sapiens
gtcgaggcaaggtatctggctgtgaccgggaggagtgcagatcgtggctgacagaggaacgggggtattgagcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatggtcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgccaaaaaaaaaaaaaaa

SEQ ID NO: 75 - DNA, 2003 bp, Homo sapiens
ggagcgcctggcggggccgctgggccgagggggccgccggcggggctggcgggcggggggcttcctgcgggcccggggggagccggcggccggcgcgggcgcggcgggccgggcaggggcgaggggcgccgggtcttgccccagaagctgcgggcacatccacgcctgaaatgcggcgctcagtcctggtcaggaacccaggccacaaaggcctgagacccgtttatgaagagctcgactctgactccgaggacctagaccccaatcctgaagatctggacccggtttctgaagacccagagcctgatcctgaagacctcaacactgtcccggaagacgtggaccccagctatgaagatctggagcccgtctcggaggatctggaccccgacgccgaagctccgggctcggaaccccaagatcccgaccccatgtcttcgagtttcgacctcgatccagatgtgattggccccgtacccctgattctcgatcctaacagcgacaccctcagccccggcgatccaaaagtggaccccatctcctctggcctcactgccaccccccaggtcttggccaccagccccgcggtgctccccgcccccgccagcccgccccggcccttctcctgcccggattgcgggcgagccttccgccgcagctccgggctgagccagcatcgccgcacgcacagcggcgagaagccgtaccgctgccccgactgcgggaagtccttcagccacggtgccaccctggctcagcaccgtggcatccacactggggcgcggccgtaccagtgcgcggcctgcggcaaggccttcggctggcgctccacgctgctgaaacatcgcagcagccacagcggggagaagccgcaccactgcccggtgtgtggcaaggccttcgggcacggctcgctcctggcacagcacctgcgcacgcacggcggcccgcggccccacaagtgcccggtgtgcgccaagggcttcggccagggctctgcgctgctcaaacacctgcgcacgcacacgggcgagcggccctacccgtgtccgcagtgcggcaaggccttcgggcagagctcggcgctgctgcagcaccagcgcacacacacggccgagcgcccctaccgctgcccccactgcggcaaagccttcgggcagagctccaacttgcaacaccacctgcgcatccacacgggcgagcggccctacgcctgcccgcactgctccaaggccttcggccagagctcagcgctgctccagcacctgcacgtgcattcgggcgagcgtccctatcgctgtcagctctgcgggaaggccttcggccaggcctccagcctcaccaagcacaaacgggtgcatgagggtgcagccgctgctgcagctgccgcggccgctgcagctgcagcagcggccgccggcctgggcctcgggcctggcctaagccctgcatccatgatgaggccggggcaggtctccctcctgggtcctgatgctgtttctgtgctcggctctggcttgggcctcagccctggcaccagctctggccgcaaccctgaccctggctctgggccgggcactctgccggatcccagctccaaacccctccccggctccagatccacccccagccctactcctgtggaatcttctgacccaaaggctgggcacgacgctggtcccgaccttgtgcccagcccagaccttgatcctgtgcccagcccagaccctgatcctgtgcccagccctgatcccaaccctgtgtcctgccctgacccctgttctcccactcgtggcactgtcagcccagccctccctaccggcgagagtccagagtgggtacaggagcaaggggcactgctggggcctgatggctgaaggagacgccggcatcctcgggggcctggggaagttgtgtgttgtgcagtcagtaaaatcctcccactgcctccggaaaaaaaaaaaaaaaaaaaaaaaaaaaaaaaaaaaaaaaaaaaaaaaaaa

SEQ ID NO: 76 - DNA, 4637 bp, Homo sapiens
gtgcttcagaaaccaggagtttccgcctcggctcccccatgtccccttgtcatcccctgggtccccccagatcctcacccctccacacacactctcccgttcctagaggttccacctctgggctctctccttgccatttctttttcaaagatttccttagctgtcttctcctgagttcctggtccccttctcttcccttgcacccctccttcctatcgttccgatgggggcagtgccctgacttgggggcaggatccccggctaggctcttggggcctttctgggatgggatatttgggaagaccggtccggaatctaagaacccagaccctgtcccagtcctgtgcattcaggtgggcccgagggcgaggcgagatccagtgaggtccaggcctggtgcagccctagggaggcagcgtccatggagcaaaaggaatgccaggatcctgcacaggcagacgcgggccagcctcagcaccgacagccgacgcgcagatagcagagccatccttggggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgcgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccctgtcgccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaaaaaaaaaaaaaaa

SEQ ID NO: 77 - DNA, 4090 bp, Homo sapiens
gggcgctcccggagtatcagcaaaagggttcgccccgcccacagtgcccggctccccccgggtatcaaaagaaggatcggctccgcccccgggctccccgggggagttgatagaagggtccttcccaccctttgccgtccccactcctgtgcctacgacccaggagcgtgtcagccaaagcatggagaatcaagagaaggcgagtatcgcgggccacatgttcgacgtagtcgtgatcggaggtggcatttcaggactatctgctgccaaactcttgactgaatatggcgttagtgttttggttttagaagctcgggacagggttggaggaagaacatatactataaggaatgagcatgttgattacgtagatgttggtggagcttatgtgggaccaacccaaaacagaatcttacgcttgtctaaggagctgggcatagagacttacaaagtgaatgtcagtgagcgtctcgttcaatatgtcaaggggaaaacatatccatttcggggcgcctttccaccagtatggaatcccattgcatatttggattacaataatctgtggaggacaatagataacatggggaaggagattccaactgatgcaccctgggaggctcaacatgctgacaaatgggacaaaatgaccatgaaagagctcattgacaaaatctgctggacaaagactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgagtgcaaatacgtaattaatgcgatccctccgaccttgactgccaagattcacttcagaccagagcttccagcagagagaaaccagttaattcagcggcttccaatgggagctgtcattaagtgcatgatgtattacaaggaggccttctggaagaagaaggattactgtggctgcatgatcattgaagatgaagatgctccaatttcaataaccttggatgacaccaagccagatgggtcactgcctgccatcatgggcttcattcttgcccggaaagctgatcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagatatctgggtacaagaacctgaatcaaaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaagtaaaaacaattcaaagaatcacctaattaatttcagtaagatcaagctccatcttatttgtcagtgtagatcaactcatgttaattgatagaataaagccttgtgatcactttctgaaattcacaaagttaaacgtgatgtgctcatcagaaacaatttctgtgtcctgtttttattcccttcaatgcaaaatacatgatgatttcagaaacaaagcatttgactttctgtctgtggaggtggagtaggtgaaggcccagcctgtaactgtcctttttcttcccttaggcaatggtgaactgtcattacagagcctagaggctcacagcctcctggaggaagcagcctccactttggatcaggaaatagtaaaggaaagcagtgttgggggtagcggcatgcagaccctcagaccagaatggggacatcttgtggtctgctgcctcaggaatctcctgaccacttgtagtccctccgacttctctagacatctagtctcagtgctagcttatttgtatttttcctctttcacttcttatggaggagagtgtttaactgagttagaatgttgaaactgacttgctgtgacttatgtgcagctttccagttgagcagaggaaaatagtggcaggactgtcccccaggaggactccctgcttagctctgtgggagaccaactacgactggcatcttctcttccccctggaaggcagctagacaccaatggatccttgtcagttgtaacattctatttcaacttcaggaaagcagcagttttcttttaatttttcctatgaccataaaattagacatacctctcaacttacatatgtcttcaacatggttacctctgcataaatattagcaaagcatgccaatttctcttaagtactgaaatacatatgataaatttgactgttatttgttgagactatcaaacagaaaagaaattagggctctaatttccttaaagcaagctcacttgctttagttgttaagttttataaaagacatgaaattgagtcattttatatatgaaaactaagttctctatcttaggagtaatgtcggcccacaagggtgcccacctcttgttttccccttttaaaaactcagatttttaaaagccctttccaaaggtttcaactgtaaaatacttctttttacaatgtatcaacatatttttatttaaggggaattaacaattgccagggaaaccagccaacccaagtttattatatcattaaccttatcataaattcaaacctaagttgctggaccctggtgtgaggacataaatcttccaaagttttgcctatcctaagagctgcatttttctactgctctttaccttgcattttagctaatttaggagttttgagaatgtattggatacgctccagtacataaggagttgccgcatattatatcagactgctttgagaaatctcatccctagtctattgcagttgtttctattagcttactgattaactcagtcctgacacaccttttgggaaatgctgatttaaacttcttaactggcaacagttggaacagtaatcagtttgctaacatatttaaagtcttgaatgttgaagaactcatgtgatttacccttttcaactttttggaaaacgatttaatttattctaattagattaaccctattaatctatggattgggtatcaaaatgaatgccagtccagatgtgcctagacacgaaattggagctgaggactctcacgatatgcaagttcatccaacgtgaagataccataagctttttctctgaaccagagaaatgaaagtcagtttaagaggctgatagatcttggccctgttaaggcatccacttcacagttctgaaggctgagtcagccccactccacagttaggccaagaattagattttaaaacttcatctgtctgtcccagttaactgttaaataaggcctcatcctccactgaagagtatggattgaaggattgtgaactatgtttagtgtgattgtgaacttggtgcctaatgttccatgtctgaagtttgccccagtgctacacgttggagtatacctatgtgtgtgctttgccactgaagtaagattttgcctgtatggtactgttttgtttgttaataaagtgcactgccacccccaatgcaaaaaaaaaaaaaaaaaa

SEQ ID NO: 78 - DNA, 5184 bp, Homo sapiens
gctttacactcgcgagcggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccagggagcccaggtgctcggcgtctgaacgtctcaaagggccacagcgacaatgacagctgacaaggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtggagctaacaggacatagtatctttgacttcactcatccctgcgaccatgaggagattcgtgagaacctgagtctcaaaaatggctctggttttgggaaaaaaagcaaagacatgtccacagagcgggacttcttcatgaggatgaagtgcacggtcaccaacagaggccgtactgtcaacctcaagtcagccacctggaaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacagaatcacagaactgattggttaccaccctgaggagctgcttggccgctcagcctatgaattctaccatgcgctagactccgagaacatgaccaagagtcaccagaacttgtgcaccaagggtcaggtagtaagtggccagtaccggatgctcgcaaagcatgggggctacgtgtggctggagacccaggggacggtcatctacaaccctcgcaacctgcagccccagtgcatcatgtgtgtcaactacgtcctgagtgagattgagaagaatgacgtggtgttctccatggaccagactgaatccctgttcaagccccacctgatggccatgaacagcatctttgatagcagtggcaagggggctgtgtctgagaagagtaacttcctattcaccaagctaaaggaggagcccgaggagctggcccagctggctcccaccccaggagacgccatcatctctctggatttcgggaatcagaacttcgaggagtcctcagcctatggcaaggccatcctgcccccgagccagccatgggccacggagttgaggagccacagcacccagagcgaggctgggagcctgcctgccttcaccgtgccccaggcagctgccccgggcagcaccacccccagtgccaccagcagcagcagcagctgctccacgcccaatagccctgaagactattacacatctttggataacgacctgaagattgaagtgattgagaagctcttcgccatggacacagaggccaaggaccaatgcagtacccagacggatttcaatgagctggacttggagacactggcaccctatatccccatggacggggaagacttccagctaagccccatctgccccgaggagcggctcttggcggagaacccacagtccaccccccagcactgcttcagtgccatgacaaacatcttccagccactggcccctgtagccccgcacagtcccttcctcctggacaagtttcagcagcagctggagagcaagaagacagagcccgagcaccggcccatgtcctccatcttctttgatgccggaagcaaagcatccctgccaccgtgctgtggccaggccagcacccctctctcttccatggggggcagatccaatacccagtggcccccagatccaccattacattttgggcccacaaagtgggccgtcggggatcagcgcacagagttcttgggagcagcgccgttggggccccctgtctctccaccccatgtctccaccttcaagacaaggtctgcaaagggttttggggctcgaggcccagacgtgctgagtccggccatggtagccctctccaacaagctgaagctgaagcgacagctggagtatgaagagcaagccttccaggacctgagcgggggggacccacctggtggcagcacctcacatttgatgtggaaacggatgaagaacctcaggggtgggagctgccctttgatgccggacaagccactgagcgcaaatgtacccaatgataagttcacccaaaaccccatgaggggcctgggccatcccctgagacatctgccgctgccacagcctccatctgccatcagtcccggggagaacagcaagagcaggttccccccacagtgctacgccacccagtaccaggactacagcctgtcgtcagcccacaaggtgtcaggcatggcaagccggctgctcgggccctcatttgagtcctacctgctgcccgaactgaccagatatgactgtgaggtgaacgtgcccgtgctgggaagctccacgctcctgcaaggaggggacctcctcagagccctggaccaggccacctgagccaggccttctacctgggcagcacctctgccgacgccgtcccaccagcttcactctctccgtctgtttttgcaactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttttgtttaagctgactctttgctctaattttggaaaaaaagaaatgtgaagggtcaactccaacgtatgtggttatctgtgaaagttgcacagcgtggcttttcctaaactggtgtttttcccccgcatttggtggattttttattattattcaaaaacataactgagttttttaaaagaggagaaaatttatatctgggttaagtgtttatcatatatatgggtactttgtaatatctaaaaacttagaaacggaaatggaatcctgctcacaaaatcactttaagatcttttcgaagctgttaatttttcttagtgttgtggacactgcagacttgtccagtgctcccacggcctgtacggacactgtggaaggcctccctctgtcggctttttgccatctgtgatatgccataggtgtgacaatccgagcagtggagtcattcagcgggagcactgcgcgctatcccctcacattctctatgtactatgtatgtatgtattattattattgctgccaagagggtctgatggcacgttgtggggtcggggggtggggcggggaagtgctctaacttttcttaaggttttgttgctagcccttcaagtgcactgagctatgtgactcggatggtctttcacacggcacatttggacatttccagaactaccatgagatggtttagacgggaattcatgcaaatgaggggtcaaaaatggtatagtgaccccgtccacgtcctccaagctcacgaccttggagccccgtggagctggactgaggaggaggctgcacagcgggagagcagctggtccagaccagccctgcagcccccactcagccggcagccagatggccccgcaaggcctccagggatggcccctagccacaggccctggctgaggtctctgggtcggtcagtgacatgtaggtaggaagcactgaaaatagtgttcccagagcactttgcaactccctgggtaagagggacgacacctctggtttttcaataccaattacatggaacttttctgtaatgggtacaatgaagaagtttctaaaaacacacacaaagcacattgggccaactatttagtaagcccggatagacttattgccaaaaacaaaaaatagctttcaaaagaaatttaagttctatgagaaattccttagtcatggtgttgcgtaaatcatattttagctgcacggcattaccccacacagggtggcagaacttgaagggttactgacgtgtaaatgctggtatttgatttcctgtgtgtgttgccctggcattaagggcattttacccttgcagttttactaaaacactgaaaaatattccaagcttcatattaaccctacctgtcaacgtaacgatttcatgaacgttattatattgtcgaattcctactgacaacattataactgtatgggagcttaactttataaggaaatgtattttgacactggtatcttattaaagtattctgatcctaccactgaaaaaaaaaaaaaaaaaa

SEQ ID NO: 79 - DNA, 4704 bp, Homo sapiens
ggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggatgtggaaatggaggcccagaaagatgaaatcatctgccccagctgtaataggactgcccatccactgagacatattaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcatcctgcctcctgttcccattcctagtagctaaa

SEQ ID NO: 80 - DNA, 5946 bp, Homo sapiens
ttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaacaaacaaacagaagtaacgaagctaagaatatgagagtgcttgtcaccagcacacctgttttttttctttttctttttcttttttctttttccttttttttttttttcctttatgttctcaccgtttgaatgcatgatctgtatggggcaatactattgcattttacgcaaactttgagcctttctcttgtgcaataatttacatgttgtgtatgtttttttttaaacttagacagcatgtatggtatgttatggctattttaaattgtccctaattcgttgctgagcaaacatgttgctgtttccagttccgttctgagagaaaaagagagagagagagaaaaagaccatgctgcatacattctgtaatacatatcatgtacagttttattttataacgtgaggaggaaaaacagtctttggattaaccctctatagacagaatagatagcactgaaaaaaaatctctatgagctaaatgtctgtctctaaagggttaaatgtatcaattggaaaggaagaaaaaaggccttgaattgacaaattaacagaaaaacagaacaagtttattctatcatttggttttaaaatatgagtgccttggatctattaaaaccacatcgatggttctttctacttgttataaacttgtagcttaattcagcattgggtgaggtaataaaccttaggaactagcatataattctatattgtatttctcacaacaatggctacctaaaaagatgacccattatgtcctagttaatcatcatttttcctttagtttaattttataaacaaaactgattataccagtataaaagctactttgctcctggtgagagcttaaaagaaatgggctgttttgcccaaagttttattttttttaaacaatgattaaattgaatgtgtaatgtgcaaaagccctggaacgcaattaaatacactagtaaggagttcattttatgaagatatttgctttaataatgtctttttaaaaatactggcaccaaaagaaatagatccagatctacttggttgtcaagtggacaatcaaatgataaactttaagaccttgtataccatattgaaaggaagaggctgacaataaggtttgacagaggggaacagaagaaaataatatgatttattagcacaacgtggtactatttgccatttaaaactagaacaggtatataagctaatattgatacaatgatgattaactatgaattcttaagacttgcatttaaatgtgacattcttaaaaaaagaagagaaagaattttaagagtagcagtatatatgtctgtgctccctaaaagttgtacttcatttcttttccatacactgtgtgctatttgtgttaacatggaagaggattcattgtttttatttttatttttttaattttttcttttttattaagctagcatctgccccagttggtgttcaaatagcacttgactctgcctgtgatatctgtatcttttctctaatcagagatacagaggttgagtataaaataaacctgctcagataggacaattaagtgcactgtacaattttcccagtttacaggtctatacttaagggaaaagttgcaagaatgctgaaaaaaaattgaacacaatctcattgaggagcattttttaaaaactaaaaaaaaaaaaactttgccagccatttacttgactattgagcttacttacttggacgcaacattgcaagcgctgtgaatggaaacagaatacacttaacatagaaatgaatgattgctttcgcttctacagtgcaaggatttttttgtacaaaacttttttaaatataaatgttaagaaaaattttttttaaaaaacacttcattatgtttaggggggaactgcattttagggttccattgtcttggtggtgttacaagacttgttatccatttaaaaatggtagtggaaattctatgccttggatacacaccgctcttcaggttgtaaaaaaaaaaaacatacattggggaaaggtttaagattatatagtacttaaatataggaaaatgcacactcatgttgattcctatgctaaaatacatttatggtcttttttctgtatttctagaatggtatttgaattaaatgttcatctagtgttaggcactatagtatttatattgaagcttgtatttttaactgttgcttgttctcttaaaaggtatcaatgtaccttttttggtagtggaaaaaaaaaagacaggctgccacagtatatttttttaatttggcaggataatatagtgcaaattatttgtatgcttcaaaaaaaaaaaaaagagagaaacaaaaaagtgtgacattacagatgagaagccatataatggcggtttgggggagcctgctagaatgtcacatggatggctgtcataggggttgtacatatccttttttgttcctttttcctgctgccatactgtatgcagtactgcaagctaataacgttggtttgttatgtagtgtgctttttgtccctttccttctatcaccctacattccagcatcttaccttcatatgcagtaaaagaaagaaagaaaaaaaaaggaaaaaaaaaaaaaaaccaatgttttgcagtttttttcattgccaaaaactaaatggtgctttatatttagattggaaagaatttcatatgcaaagcatattaaagagaaagcccgctttagtcaatacttttttgtaaatggcaatgcagaatattttgttattggccttttctattcctgtaatgaaagctgtttgtcgtaacttgaaattttatcttttactatgggagtcactatttattattgcttatgtgccctgttcaaaacagaggcacttaatttgatcttttatttttctttgtttttatttttttttttatttagatgaccaaaggtcattacaacctggctttttattgtatttgtttctggtctttgttaagttctattggaaaaaccactgtctgtgtttttttggcagttgtctgcattaacctgttcatacacccattttgtccctttattgaaaaaataaaaaaaattaaagtaca

SEQ ID NO: 81 - DNA, 2207 bp, Homo sapiens
cacttcctccccagacaggggtagtgcgaggccgggcacagccttcctgtgtggttttaccgcccagagagcgtcatggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggcccacgagcttgttctttgttctttgtcacagggactgaaaacctctcctcatgttctgctttcgattcgttaagagagcaacattttacccacacacagataaagttttcccttgaggaaacaacagctttaaaagaaaaagaaaaaaaaagtctttggtaaatggcaaaaaaaaaaaaaaaaaaaaaaaaa

SEQ ID NO: 82 - DNA, 1303 bp, Homo sapiens
ctgcagccggtgcagttacacgttttcctccaaggagcctcggacgttgtcacgggtttggggtcggggacagagcggtgaccatggccaggctggcgttgtctcctgtgcccagccactggatggtggcgttgctgctgctgctctcagcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgtcagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcctggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagccgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaaccacaaaaaaaaaaaaaaaaaaaaaaaaaaaaaaaaaaaaaaaa

SEQ ID NO: 83 - DNA, 2426 bp, Homo sapiens
acttagcagagaagaatcaaatttccgggggcaaagcaaaataataaaatgaatgtcaggatattttatagtgtcagtcagtcaccccacagtctcctctctcttcttttctactgtgctatcctagaatcaaggatttcagcaacaatgcctctgttcaaactcccagctgaagagaaacaaattgatgatgcaatgcgcaactttgctgaaaaagtgtttgcctctgaagtcaaagatgaaggaggtcgtcaggagatttccccctttgatgtggatgagatctgtccgatttctcatcatgagatgcaagcacacatattccatctggagactctgtccacctccacagaagccaggagaaaaaagcgtttccaaggacggaagactgttaatttgtccattccactaagtgaaacatcttccaccaaactgtcccacattgatgaatacatttcctcatctccaacctaccagaccgtgcctgattttcagagagtgcagattactggtgactatgcctctggggttacagttgaagattttgaaattgtttgcaaaggtctgtatcgggcactatgcatacgtgagaaatacatgcagaagtcgtttcagaggttccctaaaaccccttccaaatacttgcggaacattgatggtgaggcttgggtagcaaatgagagcttctatccagtctttactcctcctgtgaagaagggagaggaccccttccgaacagacaaccttcctgaaaacctgggctatcacctcaaaatgaaggacggtgtagtttacgtctatcctaatgaagcagcagtcagcaaagatgagcctaagccacttccttacccaaatctggacaccttcttagacgatatgaattttttacttgctttaattgctcaaggacctgttaagacctatacccaccggcgcctgaagttcctctcctccaagttccaggtccatcagatgcttaacgagatggacgagttaaaggagctgaaaaacaacccccaccgagatttttataactgcaggaaggtggacacccatatccatgcagccgcttgcatgaaccagaaacatctgctgcgttttattaagaaatcttaccaaattgatgctgacagagtggtctatagcaccaaagagaagaatctgaccctaaaggaactttttgctaaattaaaaatgcatccttatgacctgactgttgattctctggatgttcatgctggacgccagaccttccagcgttttgataagttcaatgacaaatataatcctgtaggagcaagtgagctacgggacctctacttgaagacagacaattacattaatggggaatattttgccactatcatcaaggaggtaggtgcggacctggtggaggccaagtaccagcatgctgagccccgcctgtccatctatggccgcagtcctgatgagtggagcaaactctcctcctggttcgtctgcaatcgcatccactgccccaacatgacatggatgatccaggttcccaggatctatgatgtgttccgttccaagaatttccttccacattttggaaaaatgctggagaatattttcatgccagtgtttgaggccaccatcaacccccaggctgacccagaactcagtgtcttcctcaagcatatcactggctttgacagtgtggatgatgagtccaaacacagtggccacatgttctcctccaagagtcccaagccccaggagtggacattggaaaagaatccatcttacacttactatgcctactacatgtatgcaaacatcatggtgctcaacagcctgagaaaggaacgaggcatgaatacgtttctgttccgacctcactgtggagaagctggagccctcacccatctcatgacagcattcatgatagcagatgatatctctcatggcctaaatttaaaaaagagtcccgtgctacagtacttgtttttcttagcccaaattcccatcgccatgtcaccactaagtaacaatagcctatttctagagtatgccaaaaatccttttttggatttccttcagaaagggctaatgatctcactgtctacagatgacccaatgcaattccactttaccaaggagcccctaatggaagaatatgctattgctgcacaagtcttcaagctgagcacctgtgatatgtgcgaagtggcaaggaacagtgtcttgcagtgtggaatttctcatgaggagaaagtaaagtttctgggcgacaattaccttgaggaaggccctgctggaaatgatatccggaggacaaatgtagcccaaatccgcatggcctatcgctatgaaacctggtgttatgaactcaatttaattgctgagggtcttaaatcaacagaataaaaaaaagtaaaccaaaaaaaaaaaaaaaaaaaaaa

SEQ ID NO: 84 - DNA, 3912 bp, Homo sapiens
cctttagagatcggtggtgctgaagggcagggatcttattccaccttctgaagcttctgtcgaaccagttgtaaggagaatggagagagcagtgagagtggagtccggggtcctggtcggggtggtctgtctgctcctggcatgccctgccacagccactgggcccgaagttgctcagcctgaagtagacaccaccctgggtcgtgtgcgaggccggcaggtgggcgtgaagggcacagaccgccttgtgaatgtctttctgggcattccatttgcccagccgccactgggccctgaccggttctcagccccacacccagcacagccctgggagggtgtgcgggatgccagcactgcgcccccaatgtgcctacaagacgtggagagcatgaacagcagcagatttgtcctcaacggaaaacagcagatcttctccgtttcagaggactgcctggtcctcaacgtctatagcccagctgaggtccccgcagggtccggtaggccggtcatggtatgggtccatggaggcgctctgataactggcgctgccacctcctacgatggatcagctctggctgcctatggggatgtggtcgtggttacagtccagtaccgccttggggtccttggcttcttcagcactggagatgagcatgcacctggcaaccagggcttcctagatgtggtagctgctttgcgctgggtgcaagaaaacatcgcccccttcgggggtgacctcaactgtgtcactgtctttggtggatctgccggtgggagcatcatctctggcctggtcctgtccccagtggctgcagggctgttccacagagccatcacacagagtggggtcatcaccaccccagggatcatcgactctcacccttggcccctagctcagaaaatcgcaaacaccttggcctgcagctccagctccccggctgagatggtgcagtgccttcagcagaaagaaggagaagagctggtccttagcaagaagctgaaaaatactatctatcctctcaccgttgatggcactgtcttccccaaaagccccaaggaactcctgaaggagaagcccttccactctgtgcccttcctcatgggtgtcaacaaccatgagttcagctggctcatccccaggggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggcctttccagaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactcccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaagagaataaaagcaggctgcctgagccagcagtgacaacccccctcgggtcccctcccacgccgtggaagctttgttctttcgctctttgcaataaatcttgctactgcccaaaaaaaaaaaaaaaaaa

SEQ ID NO: 85 - DNA, 5268 bp, Homo sapiens
atcatggagtgcaagattgagggaaaagaaaaataccaacatagcttgaatttactgaataaaattcagaacatgaaagaattagcagaaatgattgatgtggtactcacagcagaaggagagaaatttccttgccacagactggtcctggctgcatttagcccttatttcaaagctatgttcacctgtggactacttgaatgtaatcaaagggaagtcatactttatgacatcacagcagaaagtgtgtcggtgttattaaattacatgtacaatgcagctttggagatcaataatgccaatgtacagactgtagctatggctgcctattttatgcagatggaagaagtcttcagtgtgtgtcaaaaatatatgatggaccacatggatgcctccaactgtttaggtatctattattttgcaaagcagattggagctgaagatttatctgatcgatcaaagaaatatttatatcagcactttgccgaggtgagcttacatgaagaaatactagaaatcgaagtgcaccaatttttgacacttattaaatcagatgatcttaacatatccagagaagagagcattctggacttagttctgagatgggtaaatcataacaaagaattgcgtacagtgcatcttgttgagcttttgaagcaagtcagattggaacttgtaaatccttcttttttaagacaagccctaagaaggaacacaatgcttctgtgtgatgcagattgtgttgacataattcaaaatgcattcaaagccatcaagacaccccaacagcactctctaaatctgcgctatggtatggagactaccagtcttctgctttgcattggcaacaattcttcaggaatcagatcaagacataggagctatggggatgccagtttttgttatgatcctgtatcacggaaaacctatttcatctcatctcccaagtacggagagggtttaggaactgtgtgtactggtgttgtcatggaaaataatactataattgtggctggagaagcaagtgcctctaaactctctagacaaaagaacaagaatgttgaaatttataggtatcatgatagaggaaaccagttttgggaaaagttatgcacagctgaatttcgagaactctatgctctgggcagtattcataatgacctttatgttataggaggacagatgaaaattaaaaaccagtatcttattacaaactgtgttgataagtactctgtagaacgggacaattggaaaagggtgtctccccttccactgcaattggcatgtcatgctgtagtgacagtgaataataaactttatgtaattggaggctggacccctcagatggatcttcctgatgaagaacctgatcgattaagcaacaaactgttgcagtatgaccccagccaagatcaatggagtgtgcgggcacccatgaagtactctaagtaccgattcagtacagctgtagtcaacagtgagatttatgttttgggtggcattggctgtgtaggtcaagacaagggccaggttcgaaaatgccttgacgtggtggagatctacaacccagatggggacttttggcgagagggccctcccatgccaagtcccctcctctcactccgcaccaattccaccaatgcaggggcagtggatgggaaactctatgtctgcgggggattccatggagcagatcgccatgaggttatctccaaagaaatattggaactggacccatgggaaaaccagtggaatgttgtagccatcaacgtcctcatgcatgacagctatgatgtctgcctagtagccaggatgaatccccgagacctcatccccccgccttcagatttggtggaagaaggcaatgagcactaaggtgaccttgctggaggacctcctgctgttctgcaaacaaggccttcagaacggagagggcccacagcatctctgtcatgccagtcatgtgcactgcatgcgtagtggcctgtgtgtgaagaagcagtgtgtgctgggcactgggtggggagcatggggagtctcccttcagggacttcccagcctgatagggtaaataagacactacaaagaagaggtgatgacggccacaggaggggcacagggccacaggagagcagcagagggagggtctcactctgctggggacccatgaacagcactgccaaggagcagaccttttattgggtccccaaaaggatgaggaggaagtggtcccatgggtgcagtcaatgatgagttcatggaaacagccaagcaagggcccagagacagaaagctcgtgcctgtctgcagtatcctggctgggccagattgcctggggcacagggtttgtggtcaaggctggaaaagtaggttgtagctagatgaccaacgcctgaaagaatgaggagttggacctggtctgtaagccagggaattgtctcaaaatcgtgcattaagggagacttctctctgtgctctgttccagcttcagtcttataaacactgaccattctccttcagaatccccttctactgaagcaacgccacccagcagcagggctagctgtactaccagcccctaacaaccaaggcactcaagccagaccacagtggccaagaatcctgccctgggctgactctgtccgggacagggatgtggggttctgcagcctggtccactccggggctggcagggagtgtcctggagtgggctgacccaggctgcctttgcccacctctcagacacatacaaccatctgcagggtagtcctggctgaacaggactcgcccaagccacccaagccagggacagagaaggctctggctgaggacaggggaagaagcatctcctccagctgctgccaaccccatggcccggcctttgcaataaagatggagccacccacttcagcccacaattgagcataatcagaagacagtcactcccaaaatatatgttagaaataacatttaaatgacacatgggaagtccgtctatcttacttcccgtctctaattctggaagcacagtggattcaatgagggcatcttcatagctcttcttcagcaacttctccaaagagtttcacattgcacaaggctcttttggaagcaggagtggtcagtaaattcagagggagacaaaccctaagtagagacagctttctttggtgctgagctgtgtgattgtgatgaccgctagcctgtgcccctaggttccagctgcccaccaggcaggacaggcaggtcttgccaaaactggagcctgttggaaacctatttctgccaccaaggagagggaccaggagacccagcgtaggttggccccaagtaggctcaactcgggagggtgggggtcccgcctttctcttcgcacttgtgccccaagtgcactcacagtacctggcatgtgggtgacctcttgggtggccggcatggggcagtgtttctcaatcagagggcctgggccccgagcacgtccaggaatctgagttaaagtgagcttactctttccccagtggatgatcatgatctgtgcattctttttcttgctacaaagatgttcctcctagctgctgtgttggctgtcggcggccagggttgaggacggcctccacagggcctccacttccctccattcctcttcacatagtcactccacctgctccacctgcttgaaaagtccagaaagctgccgcgtctccctggctcaaggaggccttgttggcatgtcatggcacatctcctagatgttttgggttcaagatctgggttccagcccccgctctgctacttagctaaccatgtgaacttgggcaagatgacctttctaaagcctcatttccctcatatgcagagtgggaaggaaaatattaatacatactttatagggttggtatgaggattaagtgctgagcaaagtgcctgtgaaatcctgaaataataagcatgttttagctgccattattatcatcactgtcattatcattgcagtcagcacttcccaaagcaaggtgcccaaaacagactcagtgctttagggaagtggggcagatgtgcatatggcttgtgacggttctttctttttttttttttttttgagacggagtctctctctctcgccaggctggagtgcagtgcagtggcacgatctcagcccactgcaacctccgcctcccaggttcaagtgattctcctgcctcagcctcccaagtagctgggattacaggcgcccaccaccacacccagctaatttttgtatttttagtagagacggggtttcaccatgttggccaggatggtctcaatctcttgacctcgtgatctgcccgcctcggcctcccaaagtgctgggattacaggcatgagcccctgcacctggctgagatggttcttaatttcccataccctgttgcttggctcctccagttggcggctgagagttaagcaagggtttactcggatctgaggcccccgatgccctcaatggacacattcaggaccctgtggcagctcagcagaggcacctgagggtcacgctaggtgagaccatcgcccgcctgtgggaggcaagataagtgggtaaacatcattcctgtctaatgcgaggtctgggcagtgtcccagtggaactttccagagagtgccaagggaggaccgagaaggggcatgacctctgctggagccaggagggcagtgaccaggagctggcttagcactgaagggaagcaggcatcaagggcaggatttctcaaacttcttctgaggaatccccgaggtcgaaaccggtgcttcacagatttcagatgtctgatcttgatttttctttgattccatacaacagattgcttgcctgggttagtgcttattttaagttcttggtgcttcttgtctgacttctgtatttgcaattaaaaacaacatgaccctccccacctgcagccagatatcgttagaaattcaacttcgaaatatattcctatcactcctgttttcactttaatagaaggctgttgcagtactgcatgatgggctcttataaaacttctactatctgctaattcttatctttgtgacaggattgtttgacactgagcaaggaaacacaataaggaagtaatttggatgctaggctggcagaagcctgcagctgtcaaccacagcctgccccagtgtgttcaacacggtggcattgttctccctgacttcataatgagcaaatgtttcacatttgaacttaaggaataaatttttactaataaaagatca

SEQ ID NO: 86 - DNA, 3403 bp, Homo sapiens
gggtccggcccaggaggcttgggcgcgcgcagccatcccgggcctcgccggggacctagggacgcaggcaacgcctgcgcccgctcaccatggtcgagggacgcgtctccgagttcctgaagaaactcggcttctcgggcgggggccgccagtaccaggcgctggagaaggacgaagaggaagccttgattgatgaacagagtgagctgaaagccatcgagaaagagaagaaggtgacagccctgccccccaaggaagcgtgcaaatgccagaaagaggatttggccagagcgttttgtgtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggagtacaggtcggagaaatctctggaagagctgaccaagatggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctcggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggataattaaaaaaaaaaaaaaaaaaa

SEQ ID NO: 87 - DNA, 1760 bp, Homo sapiens
gaaaacaaactcaggaagaaaaagaaaagcagaagtgatcaaggagagcgctcgagttgcaatattttcctttggctgctgacaggcagttactataaagcattgtgcatggtaggaaaatggaggctaagaaaagttaatttgtccgagggccctctgatgatagtgaaactgggatggaacctctgcctgcttgcttctgaggtctgggctcctaactactgctctactgcctcgagccaagagatttacgccctattaagcaatttgttgtgcgataaattggaagacacagcagataagcaaacaactcaagcaaccaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaaaaaaaaa

SEQ ID NO: 88 - DNA, 2375 bp, Homo sapiens
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggcagctggatgtcatgccgctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagctaaaaaaaaaaaaa

SEQ ID NO: 89 - DNA, 3300 bp, Homo sapiens
acttctccttttgctctcagatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaaaaaaaaaa

SEQ ID NO: 90 - DNA, 968 bp, Homo sapiens
ggagctggctggaatctctcagcctcacctgccagacaacaccccctccttcctcaccctgtctcctgcattctcctgaaaccttcatccacacaatgcctcccaacctcactggctactaccgctttgtctcgcagaagaacatggaggactacctgcaagccctaaacatcagcttggctgtgcggaagatcgcgctgctgctgaagccggacaaggagatcgaacaccagggcaaccacatgacggtgaggacgctcagcaccttccgaaactacactgtgcagtttgatgtgggagtggagtttgaggaggacctcaggagcgtggacggacgaaaatgccagaccatagtaacctgggaggaggagcacctggtgtgtgtgcagaaaggggaggtccccaaccggggctggagacactggctggagggagagatgctgtatctggaactgactgcaagggatgcagtgtgcgagcaggtcttcaggaaggtcagatagccggagaggagccaagatccctccagacagcaccagctcacagacgctcttgttgtgcccccttcaagcccagattgtgccaggtcagctgtcccttcctctggccacctttcctccctctgggtccctcctcacccctccccgtgttaatctgtaacttgcagcccccaggccaaagtcctttctcacactccactgcccaatagtgacctcacttccaggtcaaggtctggcgtcccaaatgaaagaagcaggcaaagggaaggagcccctgagaacaaccaatctccgctctctcctgtccatttgacctcttcttttccttctaagaaagaactaagctttgggcatttggcgattagtgaaaattctatcctgatggacttctggaaaactgtgactggggttcaagagtttaaacaggggctactggcagaaaaaaaaaaaaaaaaaaaaaaaaaaaaa

SEQ ID NO: 91 - DNA, 3109 bp, Homo sapiens
agcctgagaatagttagcaaacaagggaggttgtcatttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatctcgactcccatccccatctatctgtgccctgagcatggctctgcccccaggtcgtcttgcacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaagttctatgctaaaggcaatttatcttgatgtgatgataaaccaaacttattagcaagatatgcatatatatccataaattctctttactctgtctccatcacttgatgcacataagtgccctgacctcagcatctcccctctaaaaaaaaaaaaaaaaaagtatctctttatctttcttccatagcctgacactgatatttgtgcacttaccttaactttggtctattttattcatccaaaaccattacatttcttggttttcacaaatgttccccatttcttagccagttccagacaatgtatagcaagcaggggaaggaaagcagtcaggagttcctgggtggccacggctctgcaatagcacttatgtcatggaagtgatatcccacctcctacatatactctttgcctaggtttttggaacaaggttatagtcagacactgtatctttagattgatgtcgaccacaaagttcagccagagcttgaggctagatgcacagccttgctattgggaagaaggccttttctagctgtacaacacagtctcactgggcattcatccagaaatagagaagaaagtctgccagacttgagttatgttgtcttttattagcagggaatgtcatcacagattggatagtacatccaggtgcaatgtcaccatcagcaaggtcagcttgacactcaagtggaagattagggaagaatgactaggataaaaaaaaaaggagggcaccaagggaaagggatgatggggtgagctggcgagtgtgggtgggaaatgaaatgtttattgaggatctgctttgtgctgggcactttaatccacattttatcgtttacttttcaaacagatgcaccttacccccaccccaatgctctgtccctgcagatatcagaagacagtgtgattttcatgctctgaagttcagttttacatccaagcatccctctctgttttttaacaatccaaagacaggccaaaaaaagcaccacagtttattaagtacttactaagcacccatccactgccccacactgtggcaaggattgtgaggggtaaagaagcatggggcacaatattctgctgccttcatgtaacttacagtctcacaaataaatagaacttcagttgaaatactgacattaattaaatagagttgtaataaaaaaaaaaaaaaaaaaaaaaaaaa

SEQ ID NO: 92 - DNA, 4071 bp, Homo sapiens
tgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagatcctcgtccctcccaagatgttgtttacacgaggggcttcataacggattctaacggaagacactgaaaagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagataggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagatttttttaatttatattttcatcctgaccagcttagttctaataatttttagttgtgagtgattaaaaaactttggatcaattttggtcaaacatgccaactttgtagtctgagtgacaggcaaggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactcta

SEQ ID NO: 93 - DNA, 3398 bp, Homo sapiens
aacctggagatttaaaagccgccggctggcgcgcgtggggggcaaggaagggggggcggaaccagcctgcacgcgctggctccgggtgacagccgcgcgcctcggccaggatctgagtgatgagacgtgtccccactgaggtgccccacagcagcaggtgttgagcatgggctgagaagctggaccggcaccaaagggctggcagaaatgggcgcctggctgattcctaggcagttggcggcagcaaggaggagaggccgcagcttctggagcagagccgagacgaagcagttctggagtgcctgaacggccccctgagccctacccgcctggcccactatggtccagaggctgtgggtgagccgcctgctgcggcaccggaaagcccagctcttgctggtcaacctgctaacctttggcctggaggtgtgtttggccgcaggcatcacctatgtgccgcctctgctgctggaagtgggggtagaggagaagttcatgaccatggtgctgggcattggtccagtgctgggcctggtctgtgtcccgctcctaggctcagccagtgaccactggcgtggacgctatggccgccgccggcccttcatctgggcactgtccttgggcatcctgctgagcctctttctcatcccaagggccggctggctagcagggctgctgtgcccggatcccaggcccctggagctggcactgctcatcctgggcgtggggctgctggacttctgtggccaggtgtgcttcactccactggaggccctgctctctgacctcttccgggacccggaccactgtcgccaggcctactctgtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgaggggctgtaccagggcgtgcccagagctgagccgggcaccgaggcccggagacactatgatgaaggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccccgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactcctccatgggatttgaacatatgaaagttatttgtaggggaagagtcctgaggggcaacacacaagaaccaggtcccctcagcccacagcactgtctttttgctgatccacccccctcttaccttttatcaggatgtggcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgttaaaaaaaaaaaaaaaa

SEQ ID NO: 94 - DNA, 5332 bp, Homo sapiens
acctcgcactctcagtttcaccgctcgatcttgggacccaccgctgccctcagctccgagtccagggcgagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggagccaagcagctcaccctggaggacccgcagatgtccatgagccacccctacaccatgacaacgccttacccttcgctcccagcccagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggttgccaggtgacaggaaccttttatgcttgtgccccacctgagtcccaggctcccggagtccccacagagccaagcataaggtctgccgaagccttggcgttctcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcagagctgcaagcgtttgctcaccacggccgctccctgccaagattccaggtgactctatgctttggagaggagtttccagaccctcagaggcaaagaaagctcatcacagctcacgtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggggatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaattcagaagtggagatttcagttcagcggttgaggagaattgcggcgagacaagcatggaaaatcagtgacatctgattggcagatgagcttatttcaaaaggaagggtggctttgcatttcttgtgttctgtagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccgccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgaaatgagcagcccttacagtattgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctccccaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagtttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaatttgttaaaaaa

SEQ ID NO: 95 - DNA, 3503 bp, Homo sapiens
agtgcgcaggcgcgcgctgcgacgccaacctcggcttctcgccgctaacggcatcgagtctggacgccccgtgacccgcctgggccggagcgggggcggacggcgccttcttggccctttctgcctctagcagcggcgccggggtagccggagccagcgactgggaaacggctgcattccactgcgtctccttggcctggctgggcggtcggaggctgatctgccaagattactgtttggagaccgctgcagcccacgtccacctgatagactatttactacacatagtaggttcagagccgctaaatgtccaagaccatggcgatgaaccttctggaggattggtgcaggggaatggaagtggacatccacaggtccttgttggtcacaggcatcccagaggactgtgggcaggcagaaattgaggagaccttgaatggggtcctctccccactgggcccgtaccgcgtgctcaacaagatttttgtgagggaagagaatgttaaagctgccctcattgaggttggtgaaggtgtgaatctgagcaccatcccccgtgaattcccaggaaggggtggtgtctggagagtggtctgtagagaccctacccaggatgccgagtttttaaaaaatctgaatgaattcctggatgccgaggggcgcacctgggaggatgtggtccgcctgctccagctcaaccaccccaccctgtcccagaaccagcatcagcccccagagaactgggcagaagctctgggggtgcttctgggagcagtggtgcagatcatcttctgcatggatgccgagatccgcagccgggaggaagccagggcccaggaggccgctgaattcgaggagatggcagcctgggctttagcagcagggaggaaggtgaagaaagaaccggggcttgcagcagaggtgggttctgccttaaaggcagagacccccaacaactggaatgccacggaagaccagcatgagcctaccaaacctttggttcgcagggctggagctaagtctcgctccaggagaaagaagcagaagaagaactccaggcaggaagcagtgccctggaaaaaacccaaaggcatcaattccaacagcacagctaacttggaggatcctgaggtgggtgatgctgaaagcatggcgatctcagagccgatcaagggcagcagaaagccctgtgtgaataaggaggagttggctttgaagaagcccatggcgaaatgtgcctggaagggtcccagagagccacctcaggatgcccgggcagaagccgagagcccaggaggcgcctctgagtcagaccaagatggtggccatgaaagcccaccaaagaagaaggccgtggcctgggtgtctgccaagaaccccgctcccatgaggaagaagaagaagaatccagaaaggtttgatctgggggaccacccatactgaggagttgaaagaacaaggaagaagtaccaagtcaaccaagttctctcttgtcactgaataagactttggactctcttagggcccctgttgatagagatctggccctgaggtaaacgataggtgaggtcttgggtgggagggagttggggaagggaggtggatctctatgcccttttctctaccaggcctgccgtttcaccgccttctctactcaccttctcttcggaggcaggagagttggtaagaggattgggaaaattctagaacattcattcccctttatgcatgagcagggtcactgttacactcatccatgttcagcttttctcccccacgccttgctccctcctcggaatggtcagcgacctctgcaggccctggcatttggaagagctgggtggccctgccatattcttcctcccgccttcctctcgtgtaaccagcggggtaagttaagccaggaccttcgctgcaaacctggttttattgctccttcagtctccagcttccatcctccagttatctagccaggaggtcccaagagttagttttagggaaaaagaatgtctgcctagacctcaaagtctttgagttttagagtctgttagtaaaaatggcactttgattcccatttgggatgagccctctcaggaatcctgtggggaaggggggtgattatagggaaggacgcaggcattcctaggtccccagctctaattccatccatctacccaactgtcaccatctttgcaccaaactgtcaccatctttgcagcagaaggtcactactcacattatagtaagaggggaaaaaaatcttttaaaacttggctgttggccgggcacggtggctcacgcctgtaatcccagcactttgggaggctgaggcaggtcgatcacgaggtcaggcgtttaagaccagcttgaccaacatggtgaaaccccatctctacaaaaattagctgggcgtggtggcgcgcgcctgtaatcccagctactcaggaggctgaggcagatgaattgcttgaatccaggaggcagaggttgcaatgagccgagattgtgccacggcactccagcctgggcagcagagtgagactctctctcaaaaaaacaaaacttggctgttaatgtctgccctctgaattcagacacactatattagaccagaccaccatgtgtcattgtgtgtgtgtgtgtgtgtgtttgcgtgcgcatgtgtagaggagagagcagggtccctgagataatggtttccaaactgtatcgtagccgtccacaaagatgtaatccaaatctatttttctcacgtgtttaaaaaactgaaaagtgactactcagatatgttggaagtcacatcgaagactatcagaatattaccttgtgttcataggttaacttgtttttgtacacgtcttagttatttcaggcatctctttgcttaaaattgagtttcttgtaaatgtgactgatgagcgaggttagaagtggaagaaattcctgtgcatgttctataatctgacaccctgaaagcaagtttcctttcgtcattcacatgctcttgttctgccgtgactgttcaggtgtatggtagtaagtaaatgtattaacatggtgaacagtagtaatattctatcatagagtattagcccttgcaagttttcagggcgtcttttccgacttcagtttttgtgataaagaatgtgaacagttgttagatgttctcagtgattcaactttaaaacaaatttctcgtgatgattcatttcaaaatcctgagtgagtctgactgaaaaatacgagagaaaagagagtggtttccgtttgcagctacacagctgtgtgcatcgacgttctcctggggtgtgtgccaagcgaaacccaggggtgaattggattcttgaagagaccaaagcctgtaactgtccagcttctaatttcaaaacgggtccattagggcttcgttgtgttaacaagttgacaccatgactagtaaatgtaaacgtgtatgtataaaataaagtttagcaaattaagtgtcctgttaaaaaaaaaaaaaa

SEQ ID NO: 96 - DNA, 6654 bp, Homo sapiens
gtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcaggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggttggtgtatttcatgaccagttttctataaaaatattgaatgagtttggctctttacaatggaaaagtgtaggtatttctgaaacacagagaaaatgctatttcctgccaggtggtaatgaaagcagagaggttagttcactaatagaagcattaattgcccctaaaactgaatgtgcggtgaacagccaggtctgcgtgtgcggggacacgtgctgtcacgtctgtgtaccagtttcgggggcaggggccagggttgggggaggcacccagccctcctgctgcccacgacaagaaacactgagaggtgtggggagaagtttgctcttaactttcctggtactctgtttgtggccacagtgagaggacaaacctgccttaaggtgtcctgctttgccagttatcccagatcctgcactcactgggagtccatcttgaggaaacactggcatggctgagtaattgatcaggagcagtcctgatgttgccagcagaacaaaggatgattgtgtttttcaaaacgcaactttctcagcacttcactccaaacagcagacttttgaggacagggctggaatttgttttgtgcaatatatgccttcatgaactaaggaatgttcatccccaggcagcatgcaggagggtctgtggggctcacctcctcaccttacccaccatcactcgcgcctagctctcacctctcagttgaatgaatagtgggagatcatttgacttttaatttatgagaattattttatgttatttatgtatataattaactgttttatacatagtagtctcatcaaatgaattcgggcttggggtgatattgtctccattctccagatacaagtgctccaggcatccatggaatcagcaggagaccagggctcctaagatatatttttaaaaatcagtatcgatttctttttgcctttgcagaatctaaagggcaaatgacctcgcagagactcccaacgggctttgggctcatgacgaaacacccactagcattgatcttttattcctcttccctataaaataaaggccttggaaatcacaattttatttttttaaagaagttgttttagtgcctagagtaagaccgcatcaaatgttgttaaagaacctaatttagattgtgtggtatataccactgtttatctcaatacacagacacctcttacttcttgttataagtgagaactctaaagaaaaatcaaactcccaagttttctgtaaacatacgtggtcttaatagggtcactgtctgaggcaaaatgggttgtcttaaagcaattgctacaaatttgcatcaaagaaactagatagcaaaatacaacaaccatgtaccacccaggcagaagagtcctcacctatacgcagttctgcatattgatcatcatgacaggaagtatttcgttttttaactgatcccaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggtacagctgctccccgtgaatcctggtctgtgggttgagaaggggctcgggcctctggaatgctctagcgtgtgacgtgttctcaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 97 - DNA, 1923 bp, Homo sapiens
acttctgccttgttatcagaggagcgaggatgtggcctgtgtgccgcctaatcatgcctagaactgtctgcacctgctgatcttttgcttctgcgaactggctgcacctgctgttctcctgctcataccctagcccgtgcttaccctaattccctgttctcctgcctcaccaccagaggcccgggttgtctgcacagtctcattttccacgttattcctgtaatgaacccgtcctcccacccccaccagcagttacagggctgggtgcggagaccaactctggccagacacagaggagcagcaagaacccggggcaacggtcctgtgaaaaccgaatcctcccgcttcggcgtcccaggagcccgcccctcgcccgccgcctcccctgcgtccccgccccgcgcagccgccgcgctcctgcgctccgaggtccgaggttcccgagatgaaggtctggctgctgcttggtcttctgctggtgcacgaagcgctggaggatgttactggccaacaccttcccaagaacaagcgtccaaaagaaccaggagagaatagaatcaaacctaccaacaagaaggtgaagcccaaaattcctaaaatgaaggacagggactcagccaattcagcaccaaagacgcagtctatcatgatgcaagtgctggataaaggtcgcttccagaaacccgccgctaccctgagtctgctggcggggcaaactgtagagcttcgatgtaaagggagtagaattgggtggagctaccctgcgtatctggacacctttaaggattctcgcctcagcgtcaagcagaatgagcgctacggccagttgactctggtcaactccacctcggcagacacaggtgaattcagctgctgggtgcagctctgcagcggctacatctgcaggaaggacgaggccaaaacgggctccacctacatcttttttacagagaaaggagaactctttgtaccttctcccagctacttcgatgttgtctacttgaacccggacagacaggctgtggttccttgtcgggtgaccgtgctgtcggccaaagtcacgctccacagggaattcccagccaaggagatcccagccaatggaacggacattgtttatgacatgaagcggggctttgtgtatctgcaacctcattccgagcaccagggtgtggtttactgcagggcggaggccgggggcagatctcagatctccgtcaagtaccagctgctctacgtggcggttcccagtggccctccctcaacaaccatcttggcttcttcaaacaaagtgaaaagtggggacgacatcagtgtgctctgcactgtcctgggggagcccgatgtggaggtggagttcacctggatcttcccagggcagaaggatgaaaggcctgtgacgatccaagacacttggaggttgatccacagaggactgggacacaccacgagaatctcccagagtgtcattacagtggaagactttgagacgattgatgcaggatattacatttgcactgctcagaatcttcaaggacagaccacagtagctaccactgttgagttttcctgacttggaaaaggaaatgtaatgaacttatggaaagcccatttgtgtacacagtcagctttggggttccttttattagtgctttgccagaggctgatgtcaagcaccacaccccaaccccagcgtctcgtgagtccgacccagacatccaaactaaaaggaagtcatccagtctattcacagaagtgttaacttttctaacagaaagcatgattttgattgcttacctacatacgtgttcctagtttttatacatgtgtaaacaattttatataatcaatcatttctattaaatgagcacgtttttgtaaaaaataaaaagtgggataagtgttaaaaaaaaaaaaaaaaaa

SEQ ID NO: 98 - DNA, 4971 bp, Homo sapiens
ctgcgctcccgctccagctaggactctctctgccgcctcctcctcctcctccgacctcagtcctcaccaccctcctcccgctcctcaaaagcacccccgagtccccaccccctcacgccgcacccgcgggaacgaggccttgggaattcaggggagtggctgtgggggcgcgtcgcggctcccagctcggccagcccctctttcaagacatggtctgatccccattgtaaaagctgcgccccgaagaggaggagagagtcgtgctccctgcctggggctgcagggagctctccgtgctgaagctcttgcattattttagggtggggcgaagagggccctggattttggggagtgggggtgggtggggaggaggacccgaggggggcaaggactctgtgggggagtcggtgagagactatggggaaggaccaggagctgctggaagctgctcgcactggaaatgtggctctggtggagaaactcctgtctggcaggaaaggagggatcctgggcggtggatccggacccctgcccctgtctaatctgctaagcatctggcgaggccccaatgtgaactgcacagacagttcgggttacactgctttacaccacgcagccttaaatggacataaggacatagttctcaaactacttcagtatgaggcatcaacaaatgtagcagacaacaaagggtattttcctattcacctggctgcctggaaaggagatgtggaaattgtgaagattcttattcatcatggaccatcacattccagggtcaatgaacagaacaatgaaaatgaaactgccctacactgtgcagctcaatatggacactcagaagtagttgctgttctcctagaagagctcactgacccgacaattagaaatagcaagctggaaacacctttggacttggcggcactctacggacggcttagagtggtaaaaatgatcatcagtgcacatcctaacttaatgagctgcaacactcgcaagcacacgccacttcaccttgctgcgcgcaatggccacaaagcagtcgtgcaggtgctgctggaggcaggaatggatgtgagctgtcaaacagaaaaggggagtgcacttcatgaagcagctttgtttggaaaggtggatgttgtacgagttctgttagaaacaggaattgatgccaacataaaggatagcttaggtagaactgtcttggacattctgaaagaacatccatctcagaaatctctccagattgcaacactcttacaagagtatttagaaggcgtgggaagatctacagtcctcgaagagcctgtacaggaagatgcaacacaagaaacacacatttcatctcctgttgagtctccttcccaaaagaccaaaagtgaaaccgtcactggagaattatcaaaactcttggatgaaataaaactctgtcaagaaaaggattattcgtttgaagacttgtgccacacaatatcagaccactacttagataatttgagcaagatttcagaggaagaacttgggaaaaatggaagccagagtgtaagaacctcatctacaatcaatttgtcaccaggagaagtggaagaagaggatgatgatgaaaatacgtgtgggccatcaggactttgggaagcattaactccgtgtaatggatgtaggaaccttggcttccccatgcttgcccaggagtcctatccaaagaagagaaattacactatggaaattgtaccatctgcttctctggatacatttccttcagaaaatgagaactttctgtgtgatctcatggacacagctgttacaaagaaaccttgctccttagaaattgcaagggcaccttccccaagaactgataatgcctctgaggtagcagttactactccaggaactagtaaccatagaaacagctcaacaggcccaacacctgattgttcacctccatcccctgatactgccctcaaaaatattgtaaaagtcattcgaccccagcctaaacagcgaacatccattgtgtcttctctggattttcaccgaatgaatcacaaccaagaatattttgaaatcaacacatctacagggtgcacaagctttactgccagtcctcctgctagtccacccacctcttctgtgggaaccacagaagtcaagaatgagggaactaaccatacagatgacctctcccgacaggatgacaatgatcccccaaaagaatatgatcctgggcaatttgcaggcctgctccatggatcctctccagcctgtgagtcccctgaaaatccatttcatctctatgggaaaagagaacaatgtgaaaaaggacaagatgaagtcagtttggcaaacagtcctttgcctttcaagcagtctccaatagaaaataactcagaacctttggtaaagaaaattaaacccaaagtggtcagtagaacaatttttcacaaaaaaagcaaccaactcgaaaaccataccattgttggcacaagatcaaccaggagtggatctcggaatggggaccagtgggttatgaacgcagggggatttgtggagagagcctgtactctggggagaataaggtcattgcctaaagccttgatcgacatgcatttgtcaaaaagtgtctctaaatctgattctgatctcattgcctatccttccaatgagaaaacatcaagagttaactggagtgaatcttccactgctgaacacagttctaaagggaattctgaaagaacaccatccttcacatcggaatgggaagaaattgacaaaataatgagttccatagatgttggaatcaacaacgaacttaaagagatgaatggtgagaccacaagacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttgatagaattgaatttacatatagctgataaagcctaaatagaaaggttgatgtatttagcttgaatccttcactttagtggtctaatcaacagataaatgacaagcaaagaatgaaacaatccaaaaatgtttttcaaaacaattttgtgaattttatttttacaaaaattttttaaattcatattttaaaatgtataccaaggcaaaaaaatcatataagctatatcataaatacaagagtttcaaaacatacaagagacatataatgtaaaaaaaaattatatatatgaagtccaatgtaatttataatacaaaaaaatacagcaagggaaaatgctttagaaatgctcatctgcaaactacaaaacaaaatcctcctcttgaccgactgcatgaactgccatgaaatttgcagctccatcatactaggtatctcttctttcttcatgttaccttgtctttcttcccatttttcttttaagacagggtcttgctatgtcacccaggctggactcaaactccagggctcaaggaatcctcctgtcttagcctcccaaggagctgggattacaggcacgtgccaccgcacctggctcctaatttctttttaagacaagggccattcaaggctttttaaaacctgatgtgtgttgttatactttataacagtcagtggcttttaattccaaaaggtaatactttatactctgcctacatgagatgagcccctaacagtgtgtacaaataaaattatgatttgggtattctaaaaaaaaaaaaaaaaaaaaaaaaaaaaaaaaaaaaaaaa

SEQ ID NO: 99 - DNA, 5042 bp, Homo sapiens
gcaagcatttaggaatagcatttgccaactcccaagacttggctgtccctctcgctctggccttacttacctaactgacctcctgtagtactgagttgtgtgctggccaagttcctattcctggactgctttctttcccttgaccttccttgaaatactgctaacctgacttttgactgtgatctatgtgctatctcctgtgtgaagcctaatgaaaggtccttctctaatggaaactttcattctaggagttacctcattctgttttatgtggatctgttagctccttcattaggtttcaagctgtttgaaacagtgattgaatttgctcacctttgctttcctctcagggtctacattgggaccctgagtgataatagagccttctgtagtattgaattgctttaaacagaattaaaggacattggcaccaaatgtgattttgccaatccttgggagtcttggtgcctctgtctgggcttgaccagggtagaatggctgaagaaaatgtgattcctccacccattaaattctttatttctcaactactctggaagtttttgcctctttttgtttctatccattttcatacttttaagatacccttttttactttaagataccttttttcttcctaacgtttctttacatgctcacatgcaagcccagtcatccatctctctttttcacctttctgtcctcatatatttttcttaaaatatcttttctcatctaatctcctttcctctatcaatcagcctcctaagcgaaaatggtagtgctaatgttttaaaaagtgggggaggactagaaatctgtatggaatgtaattcacttttattgcttttaaattaaatgaaacgtttttgcccttgtttccattctactcagaaggatttcagactaaatccttaagcctgccatatggaaataactgggctagagggctgctatctaatctaagcatttaattcaaacatttgaaatggtttttgcttcaagaaaacataggttgacactaagctttattttagcaaaggtttgggaaaggttctaatctgcagtatgtacactttgataaatttcatagactagagcaacagattacaatttagtttgttcttccaacataaaactattttaatcctagttataatttcactgaaggctggatttactcactggcttgttaaaactgtagataacaaccacaagcctgttatttaaacacaattcagaaatcataaatagaaattcaaaaggagagctcaatgctgcaagatgagatttgatgccctgaagaaactctctctgaaatttgccaaagaccttgtggaacttaaaatatcttcttgtttcctaccagctagatatggcagcttgagaactatttattatgaatcaagatagatattttaccaactcagaaaatgttgctttttgtttggatattaatcttgtttgttcatatttttaactaggaaagttagtacagtaatatggtggtcatccaacagaccacaagaagagaatttgtccctcattcagcattttagcaaatatttcttgaacactagccatgtgcaaggtattacagtgagtgtttctgctaataaaaatatgaattaaatttgatgtttgatcataagtagaagaactgtgatactataatattgtaagtgccatagaaaacttgctattataaaatgctgtaaggagttaatgcttgcatagggtgcagtgggtcagctagagaaggctttataaagaaagtggaatatgagctttgatgcctagccagatgtgggtatgtgaagaacagggcagggcagtggggagtgggtggattctggacagctgaaacattgttaacaaaatctcagaaatggtacaaaatggaatatgaatgagaaatacagaacatttgttaggttttatttttatgcaaattaaagagaagagttagagacaaagttaaagtcaatgggtctagaatttcagctaaaactttggtaggtagtggagaatattttatcattattctgctctttaaacaacttcagagatgattgattaatcttgattgtaaaggaagagaaattctttggaagaccagttagggggttatcatatggtctagtaaaagttaataagatctgcacaaggctgggaagagtaggattagaacagaggggtggaattaaaggacatcgtatattggaaatttctaggatttagaacctgattggaagaggaagaagaaagggaggagttaaaaataactgtaaagagccaaatctgagaactgaccctgctaaaaaagtcagacaagtcaagtggtgcagctggtgtgtgctagaagagtaaaaggccaagctatgatagcaactggtggagtgataactggcctggccgccttgaaaaggcaagactctgccagatcacagcagcatgtcaacctcagcccgtctcctgctacccaagagaagaagcccatcaggcgccggccccgggcagatgttgtggttgttcgtggcaaaatccggctttattccccatctggtttttttcttattttaggagtgctcatctccattataggaattgctatggccgttcttggatattggccccaaaaagaacattttattgatgctgaaacaacactgtcaacaaatgaaactcaggtcattcggaatgaaggcggtgtggtggttcgcttctttgagcagcatttgcattctgataagatgaaaatgcttggcccattcaccatggggattggcattttcattttcatttgtgctaatgccattcttcatgaaaaccgtgacaaagagaccaaaatcatacacatgagggatatctattccacagtcattgacattcacacgctaagaatcaaggagcaaaggcaaatgaacggcatgtacactggtttgatgggagaaacagaagtaaaacagaatgggagctcctgtgcctcgagattggcagcaaatacgatcgcctctttctcgggttttcggagcagttttcgaatggacagctccgtggaggaggatgaacttatgttaaatgaaggtaagagttctgggcatcttatgccccctttgctctctgacagctctgtgtctgtctttggcctctatccacctccttccaagacaactgatgataagaccagcggctctaagaaatgtgaaaccaagtcaattgtgtcatcgtccatcagtgcttttacattgcctgtgatcaaacttaataactgtgttattgatgagcccagtatagataacatcactgaagatgctgacaacctcaaaagtaggtcaaggaatttgtcaatggattcccttgtggttcctttgcccaacaccagtgaatccttccagcccgtcagcacagtgctaccaaggaataattccattggggagtcgttgtcgagtcagtacaagtcatctatggctctcggacctggggctggacagctcttgtctcctggggctgccagaagacagtttgggtccaatacatccttgcatttgctctcgtcacactcaaagtccttggacttagaccggggtccctccactctaactgttcaggcagaacaacggaaacatccaagttggcctaggttggatcggaacaacagcaagggatatatgaaactagagaacaaagaagacccgatggataggttgcttgtgccccaagttgccatcaaaaaggactttaccaataaggagaagcttcttatgatttcaagatctcacaataatttgagttttgaacatgatgagtttttgagtaacaacctaaagaggggaacttctgaaacaaggttttaatgttaaaagaatatatcattttacaagggtatatattttaaaacgattttcactggtgtttccttcttaaagtattggctgtaagcctttttaatcaaatggtttgtagtgtattagaattggctgcttagttctgtaatgaagatggttgtatgtttgggttacttgtgactgcagtactctatgttaccacacatgattttatttttctcttcctttgaaagcatgatctcttttattaatatgaatgcaaaatgcttgcatccaaattaaagcttattttctttacttttaagttctttgattgccctattcataaaatgaaatgtccagtatggaaaacatagggtaccaaagtgtggaccaggagtacaaattcagtcccaatactcaatacgtattatagatgactatgagtgcaaaccttaggatgtgattttctgaataattgttctttgtaggatttggttacattatttaaaatgaaaaagatctagttttagtgtgagctcagtaatgttaattggttaagttcattgtgaatcttgagttttagataagtagttatttttttcaatatcacttctgtttttagtgatattatatcaagaaacaacgtattcaagagccatggctgacagtgccagatatacttagggataaacatcaaaatgcaattatagttgctataacgttagatactcggaatcaaaatttatttgcaagctgacttgataaactaaatgaaccaataaaatttgtagaaatgctatcctgaaataattatatacatgaagacaatgttgactaatgaattaagatacattatatactagttaatgctaactagtctcagtacctgtttttagccatctgttactgtccaatagcacctcattcccacattctattttcccccggtattctttagatcctagtatttggaaaacaatcggctaaccttgacatttctttttaccttcatatgccactatctcggtagttcaaaaaaatttagttcttgataaattgccttgaagtttaccttgtgctggagagccttatgataactccaaagactttcttacggtataatacatgttgtttaggattgtgtttcttagtcactgaagataataaatattaaaatggatgttttcatcagaaaaaaaaaaaaaaaaaaaaaaa

SEQ ID NO: 100 - DNA, 1557 bp, Homo sapiens
aatagaagctaggagagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctcaaaaaaaaaaaaaaaaaaa

SEQ ID NO: 101 - DNA, 2831 bp, Homo sapiens
gcgcgcccgggtagccaagagggaggagcgcggggagcgccgacagccgcccgcccgcccgcccccgcgacgcccgcgcgcaacagttcccccaaagttgcagcccgggaggcgagcgcgcacgggcggccgaggggcgggcggttggcggggacgcggcctcgcggcccagagcggagagtcccggcgggcggcggcggcatgggcacccggcagaccaagggcagcctggcggagagagccagccccggcgccgcgccgggcccccgacgcgaacggccggacttctgggcgtcgctgctgctgcgcgccggggacaaggcggggcgcgcgggcgcggggatgcccccctaccaccggcgagtcggcatggtccaggagctgctgcggatggtgcgccagggccggcgggaggaggcggggacgctgctgcagcacctgcgccaggacctgggcatggagtcgacctcgctagacgacgttctgtatcgctacgccagcttccggaacctggtggaccccatcacacacgacctcatcatcagcctggcacgctacatccactgtcccaagccggaaggcgatgcactgggcgccatggagaagctgtgccggcagctgacataccacctcagcccccactcccagtggaggcggcaccgggggctggtgaaaaggaagccacaggcctgcctcaaggctgtcctggccggaagccccccagacaacacagtggacctgtcgggaatcccactgacctcccgagacctggagcgggtgaccagctacctacagcgctgtggggagcaggtagacagcgtggagctgggcttcacaggcctcacggacgacatggtcctgcagctgctgccagcactcagcaccctgccccgcctcaccacactggcactcaatggcaaccggttgacccgggccgtgctgcgcgacctcactgacatccttaaggatcccagcaagttccccaatgtcacgtggattgacctgggcaacaacgtggacatcttctccttgccccagcccttcctgctcagcctgcgcaagcgctccccaaagcagggccacctacccaccatcctggagctgggtgagggcccaggcagtggggaggaggtccgggaagggacagtaggccaggaggaccctggagggggccctgtggcacctgccgaagaccaccatgagggcaaggagactgtagctgcagctcagacgtgacatggaagtgaagggcctcaccagggagtccttgttgggtagaatgggcaaggcaggcaggggagggcgcttctcctatcaggtgggttaaggatattgccaaaaattggcctgggccacccacctacagaaaggcaaaccatatcatctggggaaggggatttgtgttaaaacttcccgttggtcctctgcatctgccccctatcccattatctgccatttggttcttaagtcatcccaggccccagagaaccctctcagctcagctcatggccttccccaaagacttgtggaaatgggcacatggctggaggtactgtaagcctgagccattgtgaacaccaagagctttcccccagaaaaagaatacagtagggcccctacatgtactgcattacatttttcatttaggggaacaagctccaaccagaggaatgtgtccccactcaaggaaggtgggaatctttagcaaaattcctgtaactcctggttgcccgagaccccagttccatctatgctaggggtggactgaacgtggcctacctccttatggagacccagccctatttctgaggcccaccttgattctaggcatctgcccataggaccagctatcgctatatcctttgacagagcagcctacgatgccatgtggtagtgctcaggacagacatggtgcccatgcatacaggcataaagtcctgttcagaaatcccctatccaccttccctacccactgctggctgaaaaactaccagacttctatgtgggctctgatgtccttagcatgcagggtaagtgacaaacctggcttccttcttgtcacttgccagtatgacttcactgacctagacaggccgtaagaactctttccccataactcttaagtaatccaccaacacattccagaaaaccgactgcagaaggtgggctttaaaaccttaaaaacctaggacaatgaaggagtccaatcccttggcagatccaacaagatggctggggagagggagaaacaaactggaggctcccaaaggaacctaacttagcaaaggttctcatcttataccctccccttacccaaatactgtcctactgaaagggccctaccagttaagggatctcttctaaataacaggcaacccctagatccaagtagttcagtccaggaagactgggagccaatcactcttgaaccttgtgggcaaacagtatgggggaggaccctcttgacaggccttggtaggcaagattccaacacaggaagacagcaagatggggcctagagtatggggccctacatgctgttaaggttgtggttaggaatggtgcaatgctgcaggagctggaacaaagctacaccaaggaacagagcacagagcagcaggggccgaaattgaggaggccttaaatgctttgagcttttgccttcagtctaaagctgtagaatagggggttaagagcttaggctgaccacagggaagtttacaagctagagcgaatatctggactgctaatatctgacaacagtaggcgaaatttactttttcttcaaatacacattttcaagaattgacacccaagacaaaaaaaaaaaa

SEQ ID NO: 102 - DNA, 6320 bp, Homo sapiens
aatccgctcagctcctgcaatggggcctgcctgacacttgggcgctccttcagtctcgatgttgatggcaggacaaaggggcgcctggaccatgggtgatgtggtcgagaagagtttggaagggcccctggcaccttctacagatgagccctcccagaaaacaggagacttggtcgagatcttaaatggggaaaaggtcaaatttgacgacgcgggactctccttaattcttcagaatggcctggaaaccctgcgaatggaaaacgctctgacagatgtcatcttgtgtgtggacattcaggaattctcctgccaccgcgtggtgcttgccgcagccagcaactatttcagggccatgttctgcaacgatttaaaggaaaagtatgagaaaaggatcattattaaaggggttgatgctgagaccatgcacactctgttggactacacgtacaccagcaaggcgctgatcaccaagcagaatgtccagcgggtcctggaggctgctaacctcttccagttcctgcggatggtggatgcctgtgccagcttcctcactgaagccttgaacccagaaaactgcgttggaatactgaggctggctgacacacactcgctggacagtctaaagaagcaggttcagagttacatcattcaaaactttgtgcagattctgaactctgaggagtttcttgacctgcccgtggacactctgcaccacatcttgaagagtgatgacctttacgtgaccgaggaggctcaggtgtttgagaccgtgatgagctgggtccggcacaagccatcagaacgactctgcttactcccctatgtcctcgagaacgtgcgcttaccgcttctggacccgtggtactttgtggagacggtggaagcagatcctctcatcaggcagtgcccagaggtcttcccgctgctccaggaagccaggatgtaccacctttctggcaatgagatcatttcggaacgcaccaagcccaggatgcatgagttccagtctgaggtgttcatgatcattggcggctgcacgaaggatgaacggtttgtggcagaggtgacctgcctggaccccctgaggcgcagccgcctggaggtggccaagctcccgctaacagagcatgagctggagagtgagaataagaagtgggtggagtttgcatgcgtgacattgaaaaatgaggtctacatctcaggtggcaaagaaacacagcatgatgtttggaaatataattcttcgatcaacaagtggattcagattgagtatttaaacataggccgctggaggcataagatggtggtgttgggtggcaaggtctatgtgatcggaggctttgacggcttacagagaatcaacaatgtggagacctacgacccctttcacaactgctggtcagaggccgcacccctccttgtccatgtcagttcctttgcagccaccagccataagaagaagctgtatgtgatcgggggagggcccaatgggaaactggccacagacaagactcagtgttatgacccttccaccaacaagtggagtttgaaggcggccatgcccgtggaggctaaatgcatcaatgcagtgagtttccgggaccgcatctatgtcgttggtggggccatgagagcgctgtacgcctacagcccgctggaagacagctggtgcctggtgacccagctcagccacgagcgggccagctgcggtatcgcgccctgcaacaaccggctctacatcaccggcgggcgggacgagaagaacgaggttatcgccacggtgctgtgctgggaccccgaggcccagaaactgacagaggagtgcgtcctgccccggggcgtgtcgcaccacggcagcgtcaccatcaggaagtcgtacacccacatccgcaggatcgtgcccggagcagtgtctgtctgacggcaggatggggagctggagagcccccccgaccctcagcgtacccgcctcacctctcaccctcctccagtcccacttcaggcagcaggctcgagtttgaggccatacatcaggggatccccttgactcactttgggggaaccttggaagtcacagtttggggtcacttgagaccggccaggaatgtttgcatgacctacctcaggaggggaggcgaggaagagtaatatttagcattcaggacccacccaccctatgccggcttctgtgccaggcacttccttttatcggttcatttaacctggtgactggctcttatcacttctagtttacaggtgagggaaccaagtttcacagaggctaagtggcgtgcccctgatcactcagatagcaagtagctaccccaggagtctaaaatccaggtctttcatctccgaagtcaatgctctttccaccatgctgcctatctcagagcaggaaaaacaaacaaaaaacaacaacaaaacctggctcttgctgggcgtggcggctcacgcctgtaatcccagccctatgggaggctgaggcgggcggatgacctgaggtcaggagttcaagaccagcctggccaacatggtgagaccgccccgtctctactaaaaatacaaaaattagccgcgtgcagtggcaggcgcctgtaattccagctactcaggaggctgaggcaggaggatcacttgaacttgggaggtggaggttgcagtgagccgagatcgccacactgcactgcagcccgggaaacaaaagtgaagctctgtcttcaaaacaaaaacaaaaacaaaaacaaaaacaaagaaacctggctcatttcttgtttcggcaagtctgctaaaagattcactcagcacagcagggaaataaaggtgtttcctgctttctttccttttctttcttattctgcatcctccctcgtccccgccctttaccaatatttaaaccaaggagtcatttgggctccttgccaagaacatctcataggttcttccacttgaaaggtctgggggatgggcttgggaaggcctgtttgctttgaaagagatgaaatacttgtgttctgtcctcctcccattgaaaccctcttttttttttttttgagatgaagtcgcccaggctggagtgcagtggcatgatctcggctcactgcaacctctgtcaccctggttcaagtgattttcctgcctcagcctcctgagtagctgggattacaggcacctgccaccgcgcctggctaatttttgtagttttagtagagacggggtttcaccatcttggccaggctggtcttgaacgcctgaccttgtgatctgcccgcctcggcctcccgaagtgctgggattacaggtgtgagccactgggcccggtctttttttttttaaatgatcataagatggcccattttggaccggaactgtcattgccagacagaattgtacctttagcacattctggtgccctggcctcttagtgttcaccagttgtactgcaatatagacaagatgtctctagagactcaaactactgttttattaaaaaagtaaacacctgagcacagctggcctacacaggagcgacagattctccttgatggtacactttctagtttttacacagtgatttaggtccacgttcctgataccccatcctcctgaagccttcgttttcaagacttttaaaaagcacttctacttggttttttgatcagtgtagctcaattgtgacttaaagaacagaatctgtccttcactgtaagagctacagctttcaaatgagctcactggaaattcattctaatccccaagctggagaaacaggttaagagatcctgtttcatatgctgtatttaaaaagcaacaatgataacaacatagtaactgcgttacccaatggactttattttcatcatatgatttcaattctctttatagagttttatttcatatccggtgtggcttgttcttttcagcagtttgggaagttagttattagagttgatagtgaattgaattttcattaaacagtcacggttagaagaagctaatatttgaaacagattttaaaaacttgaaaaattacaggtgagatttctgtttatgccagattattgaagataaatataaatgtatgttggtgtgtgaaatgctctgtgccttagaagcgtgacagttcagctctctgctgtggaaagtaacacagggcaatagaaacatatttgtggaattttagaacaaactattgctgactcatgagcactataataaccatcaggaagctcccaactgaagcaatgtaacagtgtaatctagttcaattcagcaaacattcatggagttcttcatgtctgtcaagccttgaggacacccacgaatggcaaatctccacgctagacactcaatacaggtaaataggccaccagttaatattcttgtttttattttcttcaagttagctaaaaatgagatgcgtatgaagtgaggaggctggatccaagtcttgattgcctttcagggggtcaaggtggtaagctgtgcagtgaagtcaaccagtggccatggcttacatgtttgtctctttgagatcgccaccagaaccatttgtgaactgatttgtgaaggaaaagtcagtcttactccaaagactattgcagggaggaacttccagagaggaaatccaatgacaatggtactggcatacacagggagcctcccttcaaaaagacagcgcccctagtcagggaggggatggcggtcctttgataagacccataggcaaacttcgagcccatcagcaggtcaaccctatgctgggaaagtgaggatttgggatttctgtgctataaacctgattctaaatgtaggacccaagtttctggactacttcagaatacctaaatgaatcatggaaacactctttatgattttttacaacaccagatatgcaggtgaattgtggaaaatgtcatgtagctgacactcaagaaatagggattcctaataatggcatgggtagggaacagatacacctggttagaaggtctagggttctgtatatgaagctgccagtctgtagctcttcgagaaagaaagttcaagtcatttgggggaaacttaagaatagtcatcagggttttagcttctaggcaccagccaaggatgagaacttctaaaatctaaaatccatttcaagaaataaagacgaacacatttgcaggaaggtaactgttataacccacaccatcagcagggggaaagccaagctgagaataaacccagagacaaagaaccctcggactcaggcaggacatggcaggatgttctggcacagcagactggagactgaggcagggcctgtgagtggacagagcacccctggctgggaagaagaagatggggtaggaggaggtcaggttccaaggatgcaggtctggaaaatgatatcggaggccctggagtttgtgagcttggctctagtcccaagaagggtgagggagaataagggtaagggagtattctaggcaaggaactaaggaaggaatccccttcttagagcagaggcacaagttagagcaggcccagcatttgggccaacttactgtggggcctctgagctgctcagctgggtctcctgtcctagagggaaggtggcccagagtctttggtggagcggaatctgtagatgaggttaagggactccagttgccaaggttgatctgaaacaggcagggagctaagctcatcagaacaccaacagattcatgttctcgtcttagctttcatctattctggtctcaatggcttcgggaaacacacatatacacatacaccatgcccttgaactcaaagcaaactacgctctcagggaaatacaaatatcacgttcttatagctgtaaagtatagcttagctatttatagaagactatgaggtactgttgtgagttatttgcttatcctgttttattctgaaaaatgaaagtgctcaatagaatttttaacgttggcaacaccataaggatttcttatgttaagtcccaacttggggttgcaaaatcattttttcccttaatacctgggtgttgtattagatctcataatttgacaagttaaccttttagaaatccacatatatctcaaatctggctactgcaaaaccagttttgacaggtcagattttcatatgtataggtataaatagccaacactcagtgaacaaaatcctttaagcattttggttacataaagttgtatgttttaagtgatcaaactaagaatattgtttataggttttaaaaaccaaaccaataaaatttttatttattcaataaaatatgcacagaacagatgcaaatgtgttatatacaa

SEQ ID NO: 103 - DNA, 2737 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatataaaaaa

SEQ ID NO: 104 - DNA, 1485 bp, Homo sapiens
gcacaaccccagcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgactcctgcctgtccaggaaaacttcctgcttaaatttcagggcatgaagctgacctcagaggagtttaacgcgatcttcacattttacgacaaggatagaagcggctacattgacgagcatgagctggatgcccttttgaaggatctgtacgagaaaaacaaaaaggaaatgaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaatgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaacttacccaaaaaaaaaaaaaaaaaa

SEQ ID NO: 105 - DNA, 1258 bp, Homo sapiens
tccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgca

SEQ ID NO: 106 - DNA, 2383 bp, Homo sapiens
gccagtggcgctgcgctgaatgcaactgcgcgcgcccgccgggtgagccagcgatctgagccaggcgggggcggcccgacctttcccgcccagcctgggtcagaggaagccgaaagcggcctcagcaagtgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttgagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaagttctccttggattattctacagctattatgtgtacataatgaaccatctttagaaaataaaagtgacatcagctctaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagacccaataaaaaaaaaa

SEQ ID NO: 107 - DNA, 1219 bp, Homo sapiens
gagaagatgtttgaaaaaactgactctgctaatgagcctggactcagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcagaagctgatggggcaaactcaagcttcttcactcacagcaccctatatacacttggagtttgcattcttattcatcagggaggaaagtttctttgaaaatagttattcagttataagtaatacaggattattttgattatatacttgttgtttaatgtttaaaatttcttagaaaacaatggaatgagaatttaagcctcaaatttgaacatgtggcttgaattaagaagaaaattatggcatatattaaaagcaggcttctatgaaagactcaaaaagctgcctgggaggcagatggaacttgagcctgtcaagaggcaaaggaatccatgtagtagatatcctctgcttaaaaactcactacggaggagaattaagtcctacttttaaagaatttctttataaaatttactgtctaagattaatagcattcgaagatccccagacttcatagaatactcagggaaagcatttaaagggtgatgtacacatgtatcctttcacacatttgccttgacaaacttctttcactcacatctttttcactgactttttttgtggggggcggggccggggggactctggtatctaattctttaatgattcctataaatctaatgacattcaataaagttgagcaaacattttacttaaaaaaaaaaaaaaaaaa

SEQ ID NO: 108 - DNA, 2906 bp, Homo sapiens
aagccaacctcgctcagcggacgactggccggatcccaacgcgctgccccttgcccagcctgcgagcgcgtggtacgaaggcgcgtctgcatccatgccccagcccggggagctggaggcgctcgcagtcagaggcgagtgatgctaggctgagcgcgtggcggcccgtgtcgtgccccgctgagccaagtgcggaagggcagcggcgcgctccgactctgctcgccgcacgcagggcggggcgcggctggggggcggggggcctggccgcccgctgggagctgcggacgagcaggcgcgctgaggacccgagggaggacacggttaaagcattgctatcaactgtgaacccagagagccctccttagccaacacgctaactccgaagcctcccttacgcccccgaaccaccgaaggcggcgacacctgattcagcgcacaaacacaggtcccttctgtcccggatacaattacgcggcagacacacactcagactcgcgcggggcagccaagagacgagctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatatgtgtggatttgtgatagctcatcttttaggggttaaatatgctgtattttcaactggcctttggtatcctgctgaagtgggtgctcctgctccattagcatacgtcccagagtttaactcactcctcacagaccgcatgaacttgctgcaaaggatgaaaaataccggtgtttacctcatttccagattaggggtcagctttctggttcttcccaaatatgaaaggataatgcagaagtacaacctgctgccggagaagtccatgtatgatttggttcatgggtccagcctgtggatgctgtgtactgacgtagcactggaattcccaagacccactctgcctaatgttgtttatgtaggaggaatcctaaccaaaccagccagcccactaccagaagatctccaaagatgggtaaatggtgctaatgaacatggctttgtcttggtgtcttttggagctggtgtcaagtatctgtcagaagacattgctaacaaactggcaggagctctggggagattgcctcaaaaagtgatttggaggttttctggacccaaaccaaagaatctaggaaacaacactaaactcatagaatggttaccacaaaatgacctgcttgggcattcaaagattaaagccttcctgagccatggtggtttgaacagtatttttgaaactatgtatcatggtgtgcctgtagtgggaattccactctttggagaccattatgatactatgaccagagtacaggcaaaaggcatggggatattgctagaatggaagacagttactgaaaaagagctctatgaagcactagtgaaggttatcaataatcccagctaccgtcagagggctcagaagctttcggaaattcacaaggatcaacctggtcaccctgtcaatcgaactatctattggatagattatattattcgtcacaatggagcccatcacctacgtgccgctgtccatcagatctccttttgtcagtattttttactggatattgcctttgtgcttttgcttggtgctgccttgttatactttctcttgtcttgggtgacaaaatttatctacagaaaaatcaaaagtctgtggtctagaaataagcatagcacagttaatggacattaccacaatggaatcctcaatggcaagtacaaaagaaatggccatattaaacatgaaaagaaagtgaaatgagccaacagcccaggtgatagaaataaattggttcactcattgaatttttattgctattatttagtctaacagctactaaaagtaaaacatcagtaaacaattctaacatgcccttatgagatctactaatgaaattctgtggaattaagatggctgtaaaaagcacaaacctaaaatgcagaaatgtattttattcaaatactgatgtagagagttttggcactgaaccttttagaagccttaattatttaaatcaattcagtgactgtgtcagaccttagttttaaatcttgatatgtgcgtgtcccggatcaggaatggtttcatttttcttaataatgtgtgtgtgtgtatgtgtgtgtgtgtgtgtgtgtgtttgtgtgtgtgtgtgtgtgtcctaattaagagaatttttactggctgcttgttacatttgttgagggtacaacacactcaagaataaagtaaaaggatagtcaggatccagatgtttcttttctagcatttaatgtgtgtgaactcagaacactaccatgaaagaacacttccccccaaaactggatgcagaggaagaaaaaaaaaaaagaaatggcacagttttttgtatttttttttttagttattttttgttgttgttgtttgtattgtttttcttttctgatagagtatggccacttctgggggaaaaacatgtaattaagtaaatgtatacattggttttcacgttttacttttgttttcccactaccaataatttt

SEQ ID NO: 109 - DNA, 2122 bp, Homo sapiens
gcgggacacagtctcttctcctctgctcttctttgggcaggtctctgggtctcaaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctatgctccacagaaagtggccatcagcatcttccaaggaaacagcgcagccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggaaaccagaaggcagggctggtggtgtcctgggagcagtctggggagctagcatcacaaccctggttttcctctgtgtttgcttcatcttcagagtgaagactagaaggaagaaagcagcccagccagtgcaaaacacggatgatgtgaaccccgtcatggtctcaggctccaggggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctccaaatacagtaaccttctgagatattgagatttaggacttccaacatatgaattttagaagggaacaatttagcccataacactgtgtccaattcttttaaaattaatgtttttgttgtaaatggactatataaataccttcgtatatatggcagaccacaggacttctgtccaagagaactgagttcaactccatctatg

SEQ ID NO: 110 - DNA, 3201 bp, Homo sapiens
aaggcgcgggccccggcgcggcggggagggctcggccggaggggaggctgcggcgcgcggccggtcgctgcgggcccgggccccaagccgtgccgctccgctcgcccgggccccgccgaggccgctgcgcccccgcctcctcgcgggaggactcgctccaaactccctgaacttcggggacagtcccccgaagcggcgaaactctcagggttggcaaccctgcccagggacccccatcccgggcggcgctccggacgccctcccctcaccgcgcccccgcagacacgtgcctggactccgagggcttctggagccaccggccgggccacgatgctcatgaggaaagtgcccggcttcgtcccggcctccccgtgggggctgcggctgccgcagaagttcctcttcctcctcttcctctcgggcctggtcaccctgtgcttcggggccctcttcctgctgccccactcctctcgcctcaagcgcctcttcctggccccccggacccagcagcctggtctggaagtggtggctgaaatcgccggccatgccccggcccgcgagcaggagccgcctcccaacccggcccccgccgcgccggccccgggcgaggatgaccccagcagctgggccagtccccgccgcaggaaaggggggctgcggcgcacccgccccactggaccccgcgaggaggccacggcggcccggggcaatagcatcccggcctccaggcccggggacgagggcgtccctttccgctttgacttcaacgcattccggagccgtctccgccacccggtcctgggaacgagggccgatgagagtcaggagccccagagccaagtgcgagcccagcgggagaaaatcaaggagatgatgcagtttgcttggcagagctataagcgttatgcaatggggaaaaacgaactccgtccactaacaaaagatggctacgagggtaacatgttcggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggaggtggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaatatgattgggctcattgcacatcagtgactcctagaaaaaccattgcaatgttaccatcagaaataataatcagccagcagttgatttaaggtataatttagtaaacgattccaacttctattacctcccctgaaatcggtcctgatatattcgagaagcatgaggccagcccttcagatgcagttgtttatttatactcaggtttagattgggaagaggcccagggaggagcagcaacttgcctgaggtcacacagcccaaaaaaggcaaaggagagtctcgcccctgccgtctcctggccaccccagttgagtgt

SEQ ID NO: 111 - DNA, 6730 bp, Homo sapiens
gctggtggcgcccgccagccggcccgggagaggggacttgagcgcttcgcggccggtgcgcagcgcggctccggccccgcagtctgtctgcaagtggccatccccgcccccgactcctgcggccggtgcgggagctgtcagctgcacgttgcgggggtaccggagaagccggggttgccttctcccggttctgtgcgctaaccccggagcccggccccggggaactagggagcgtctccggctgcacagcgctcaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccagggtggatcttttgaaagtcccaaaaaggaaaaaagatcgcacaggaggtggcggtccagagctattggcaaagatgctaaaggaacactgcaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacccatgcgtaagctacccaagtttaatttggtagctgaaatatctttttgcctcagacagctcttgaattgctcatacagaacaattctgctggtgctggagtctgaagaatattttcatttgcattttagtggttagggagaggatataagattaatggaatgtatatttttatataagacgtatacggcaccttcttgaaaaggaagcatttgaacttgttcctccctatagttctattgccttatatgcaaaattgtaccctgttgctcagagaaattattcataagagaaaagaattccaattaattaaatatcacaatagcatcccagagagacagtaggaaatttctccttagtgagagctgagtccttgagaagttaagagactgtttcctgcttcccaccccaccccgttttttgtccctccgtttgatcacctccctgttgagtatggaatgtcccagtttaatataaaacatacagtttattccacacagcagtttgactttgtaaaagtttagcaaaataactgattgttttggataactcaacatgtttttcttaaatgctgttttagtattttctacctcttaataagcaccatattttagatcttgtataaaaagttgccatctgccttatagacaaatgtagagaattgatgttcttgctttgtgttgtgttctggtaaagctttaagtgagtgtcttacccctttcctatactttcttgttatccatatcattcttttgtgagttttgcagcagtcttgaataatacagattataactactgaaaggggaaccttcgtctttttaaatgtgtcatttcacattacaataatatgtgtagtagttgaattgtgttatcaaagcatgtccaacttctgtccagatgacattaaaaccaaagcctaattgttaagcctcttattctaaagtccatagcaatgctatggaatatcaagtataatgatgtagtaaaaagatttctccagaaaacactttgagatacttaaagaaattcagagcatatcgaatgttatgaatgaagagtaaaataattacaggaaaagaatgcatgatttttcattgtcacaccaaataaccagttggacaatattgcattttcaaaatggagagttatttaaagtggatgtgtagccttctggaatctgcacgtgactggcattttaaaacaactcattaaatattggattcattttatcgagatgccaagatgaacacaatgtgaatatcatttccatttctaagcagttgaatgacacagtcagattctttggtgtatgctttgttctttccatctcaagcatttatccaaattctgctcacagacatgaggaagcaggctgtagatttaagggcactcaaggggaaaacaaatgtagtttccacagtgtgaggataaatgtagaatcgtggtaatattggctgttaaattggcctgctccagagactggctcaaaaaagaaagaagcaacgaaaacaaaatgcacagcctgaatggacgtagcactgtcatgtggcatttggaaaatctttaattatcctaatgttatttcacttgcccttatgctttattttagagtcccagggacaactggatgaaacattacgtctgtagtcatcttatttgagatgggggtgggaacgaattaaaatatgatagagaactatatgcagattttaaaatctagtcagtactagcatctataaagggcttttctgaaatttaaacagcttggtgatgcatcctgatattataagcttaaaactatcttgagggggaaatgacttcttttctccttctgtcccttttctcaaaagcatctttcccccaaatgtatgtctctaggacattttatagttttaagaggaagaaaacagaaacgtggcatcatttgggaagaaccaaggtagaatttaattttctggactttaaatctcctggttaaataatgctaatcactgtaccatttgagttacatgttttaacctcttttttttttctaattattccatccaaaatttctggtgaattacacagaaatttttggaaatgggactttgtgcaggtaaccaccctgcacttcaggtaatgttcctgtcacagctgtcgactaccccacgctgcaggaaatccattcagaaatgagctaacagtctccagtgtagcaggagagccagtcacttccctccccaggccccaaagcaccccaaggctggtattccttgagtcataggtattaataataaaagcctcaatgcagcttctccatgtagttcctctcctacaagccaggtggattctggtcctaactaaagagatgggagttcacctgagggcaagaagtacccaggatgcccaaacagccgcacaggtgtcctgtgcttcctgtgagacttcctgggggaaatatacaaactaatatattttttaatgtttacgtcatttacactgctgcttttctcatattctgcttttaattacttgtagtaaatcatttgtttgggcttcaagcactgtcttccatctgcatcttccagatttatcatgagtgatcttgttctactgttaaagatgtcaagcctaaaaagtaataaagtttttatttggctgttgaaccttgatgtagcccctactacatacactacaagttatgccttctggctactacagaatctccgcagaccttttagttatgagtagaagcaataagaaggtgtccttatggtcttaggaataatagttccaatgtattggcataatttgtttgaatgtctttattttgatattaacaccggcataaatctatttttgctaccagatgatagctattttcatttgctctattttcctctgcattgtactaatctgttactcagtgttagtcttcatttttctgtgttggaaacctgcgtcatgtaaatatctgcaaatcatgacagtctaaagtgcaaaccattttcagagactttggggaatgcagtgatcagaagtggctaatttattttatttctgattattttatccagagggtacttttttaatggatatttgtaaatcttccacttaaccactgaaaattattttgttttaatcccacccttccatccatacctctgcctccccaaaaagctcctattaatttgcttatccccctcatgtagctagttgaatgtgaataaataacatggaaaaaaaaaaaaaaaaaaaaaaaaa

SEQ ID NO: 112 - DNA, 845 bp, Homo sapiens
agcacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctcaaaaaaaaaaaaaaaaaaa

SEQ ID NO: 113 - DNA, 1133 bp, Homo sapiens
ggaggcagaggttgcagtaagccaagatcgcgccattgcacttcagcctgggcaacaagagcaaaactctgtctcaaaaaaaaaaaaaaaaaaaaaaaaaggcggtggggggaaattatctccacaaaacaaaaagtccgacaataagcaataagctgtccagggctgatacagggcatgatgaggtcatcacagatccaggttctttctgtcttctgctctgcattcgtagcctgtggctttgtcattccctcatctggaaatggcggctgcagccccaggcacaatggcccgttgaggaagaagggggacgatgtgcagtgtcaggttattttatcaggaaagttcaaagcttctcagaaatcttctgttggaattctacctgggtgtcataggccagaacacaacccaaataaccaggaaaaatgtgaaagtgagaaaatagatcgtccacccctaacaatggaggcagcaagtgagaggggattgggaatgtgtgttgatttcctcaacagtgtttgacataaccactttctagctttataatcttaggcaagtaactcaacttcccagttcctcttctgtaaaatggggataacacctgaaaaggttgttacaagattcactgaaatagtttctatgctcagtcagtaatcagcattcaatcaatatgagctctaacatgatgcttgacagttatgcaacgaacagttcatgaagagctttgtaagccatattgataattttgtctttatccttagcacagtgagaaggtattaaaggattttatgcagggaagtgacatgatcatatttgtgttttcaaaagagccctcaggctgggtgtggtaacttgcgcctgtaatcccagcactctgggaggccatggcaggcggtgggcggatcgcttgagcccaggagttccggaccagcatgggcaacttggggaaaccccacctctaaaaaaaaaatgccaaaaaaattttagctgggtgtggtggcactcgcctgtagtcccagctgctcgggaggctgaggtgagagaatcacctgagcctgggagaggctgtagtcagctgtgattgcgccatgcactccagcctgggtgacacagtgagaccctgtctcaaaaaa

SEQ ID NO: 114 - DNA, 1085 bp, Homo sapiens
ggccacgcgtgcttgagaaggttcaatggcgtggcagggactagcggccgagttcctgcaggtgccggcggtgacgcgggcttacaccgcagcctgtgtcctcaccaccgccgcggtgcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccctgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctggggattgcggtgggccatatctactacttcctggaggacgtcttccccaaccagcctggaggcaagaggctcctgcagacccctggcttcctgggacttcagagcagcaaggccccagctggcagtagcctgaccatctggacacagcagagccagggcggcccagggacggcaggagagctcgcggcaccttcctgaggccaagcaaggggagcagggttagggctgttcctgaaaggcagagagcctcttgccctgagcctcacagctactcttctcagctctctgggtctggaaggagaacaggctgaggggagctgagaggagctgaggtgctacccggagccccattcacccccacctgcccacttgggaatctgaggcagaggagggtgaggcctgtgtgccaaccttgttcacataccaccttcgtccccccaggccccggccccactcctggctctcattatttttatgttaaaactttgaagaaattgaacatgacctgttgaagaaattgaaaaaaaaaaaaaaaaaa

SEQ ID NO: 115 - DNA, 6485 bp, Homo sapiens
ctcgcccaagatggcgatggaggggcgggtgaggcggcagcggccctggcccccgcgccggccccagctcgggcccgggcccccgaggccgcgcccccgcccgcggcgccgcgcctccccgggccactgacgcccggcgcgctctccccccgcggcggcggccgaagcacggggaggcggcggcggcggcggcggcccgagcccagccccatggcgcggggggacgccggccgcggccgtgggctcctcgcgttgaccttctgcctgttggccgcgcgcggggagctgctgttgccccaggagacgactgtggagctgagctgtggagtggggccactgcaagtgatcctgggcccagagcaggctgcagtgctaaactgtagcctgggggctgctgccgctggaccccccaccagggtgacctggagcaaggatggggacaccctgctggagcacgaccacttacacctgctgcccaatggttccctgtggctgtcccagccactagcacccaatggcagtgacgagtcagtccctgaggctgtgggggtcattgaaggcaactattcgtgcctagcccacggccccctcggagtgctggccagccagactgctgtcgtcaagcttgccacactcgcagacttctctctgcacccggagtctcagacggtggaggagaacgggacagctcgctttgagtgccacattgaagggctgccagctcccatcattacttgggagaaggaccaggtgacattgcctgaggagcctcggctcatcgtgcttcccaacggcgtccttcagatcctggatgttcaggagagtgatgcaggcccctaccgctgcgtggccaccaactcagctcgccagcacttcagccaggaggccctactcagtgtggcccacagagggtccctggcgtccaccagggggcaggacgtggtcattgtggcagccccagagaacaccacagtggtgtctggccagagtgtggtgatggaatgtgtggcctcagctgaccccaccccttttgtgtcctgggtccgacaagacgggaagcccatctccacagatgtcatcgtcctgggccgcaccaacctactaattgccaacgcgcagccctggcactccggcgtctatgtctgccgcgccaacaagccccgcacgcgcgacttcgccactgcagccgctgagctccgtgtgctggcggctcccgccatcactcaggcgcccgaggcgctgtcgcggacgcgggcgagcacagcgcgcttcgtgtgccgcgcgtcgggggagccgcggccagcgctgcgctggctgcacaacggggcgccgctgcggcccaacgggcgcgtcaaggtccagggcggcggtggcagcctggtcatcacacagatcggcctgcaggacgccggctactaccagtgcgtggctgagaacagcgcgggaatggcgtgcgctgccgcgtcgctggccgtggtggtgcgcgaggggctgcccagcgcccccacgcgggtcactgctacgccactgagcagctccgctgtgttggtggcctgggagcggcccgagatgcacagcgagcagatcatcggcttctctctccactaccagaaggcacggggcatggacaatgtggaataccagtttgcagtgaacaacgacaccacagaactacaggttcgggacctggaacccaacacagattatgagttctacgtggtggcctactcccagctgggagccagccgcacctccaccccagcactggtgcacacactggatgatgtccccagtgcagcaccccagctctccctgtccagccccaacccttcggacatcagggtggcgtggctgcccctgccccccagcctgagcaatgggcaggtggtgaagtacaagatagaatacggtttgggaaaggaagatcagattttctctactgaggtgcgaggaaatgagacacagcttatgctgaactcgcttcagccaaacaaggtgtatcgagtacggatttcggctggtacagcagccggcttcggggccccctcccagtggatgcatcacaggacgcccagtatgcacaaccagagccatgtcccttttgcccctgcagagttgaaggtgcaggcaaagatggagtccctggtcgtgtcatggcagccaccccctcaccccacccagatctctggctacaaactatattggcgggaggtgggggctgaggaggaggccaatggcgatcgcctgccagggggccgtggagaccaggcttgggatgtggggcctgtccggctcaagaagaaagtgaagcagtatgagctgacccagctagtccctggccggctgtacgaggtgaagctcgtggctttcaacaaacatgaggatggctatgcagcagtgtggaagggcaagacggagaaggcgccggcaccagacatgcctatccagaggggaccacccctgcctccagcccacgtccatgcggaatcaaacagctccacatccatctggcttcggtggaaaaagccagatttcaccacagtcaagattgtcaactacactgtgcgcttcagcccctgggggctcaggaatgcctccctggtcacctattacaccagttctggagaagacatcctcattggcggcttgaagccattcaccaaatacgagtttgcagtgcagtctcacggcgtggacatggatgggcctttcggctctgtggtggagcgctccaccctgcctgaccggccctccacacccccatccgacctgcgactgagccccctgacaccgtccacggttcggctgcactggtgcccccccacagagcccaacggggagatcgtggagtatctgatcctgtacagcagcaaccacacgcagcctgagcaccagtggaccttgctcaccacgcagggaaacatcttcagtgctgaggtccatggcctggagagcgacactcggtacttcttcaagatgggggcgcgcacagaggtgggacctgggcctttctcccgcctgcaggatgtgatcacgctccaggagaagctgtcagactcgctggacatgcactcagtcacgggcatcatcgtgggtgtctgcctgggcctcctctgcctcctggcctgcatgtgtgctggcctgcgccgcagcccccacagggaatccctcccaggcctgtcctccaccgccacccccgggaatcccgcgctgtactccagagctcggcttggcccccccagccccccagctgcccatgaattggagtcccttgtgcacccccatccccaggactggtccccgccaccctcagacgtggaggacagggctgaagtgcacagccttatgggtggcggtgtttctgaaggccggagtcactccaaaagaaagatctcctgggctcaaccaagcgggctgagctgggctggttcctgggcaggctgtgagctgccccaggcaggcccccggccggctctgacccgggccctgctgccccctgctggaactgggcagacgctgttgctgcaggctctggtgtacgacgccataaagggcaatgggaggaagaagtcacccccagcctgcaggaaccaggtggaggctgaagtcattgtccactctgactttagtgcatctaacgggaaccctgacctccatctccaagacctggagcctgaggaccccctgcctccagaggctcctgatctcatctcgggtgttggggatccagggcagggggcagcctggctggacagggagttgggagggtgtgagctggcagcccccgggccagacagacttacctgcttgccagaggcagccagtgcttcctgctcctacccggacctccagccaggcgaggtgctagaggagacccctggagatagctgccagctcaaatccccctgccctctaggagccagcccaggcctgcccagatccccggtctcctcctctgcctagctcttcccagaggatgtggtttggggcaggcaggtatggatcacataggatgcgatacctgtggccgtgtatgtccacatgtgtgcctgtagatacatcatcaagccctttggagcttcctaagttgctttggctgaggggagaggaaaacatggattattcactccccccatactctttgtgatacacatgtgacatgtgaaagacatacgagacatagctacatgtgatgtgcacatgtgtgaagtgcatgtatgcgtactggttgttgagctgggaaaccgtggcccaggcagtggtcactacagcctgattggtcctccaggtcagaacggtgccccacagtggtcagtccccagccctgtgggcccccacctccatcgcccagccttttattacacactctgagagtgtctccaatgcctgtctgacaaagacagtcccagcccattctcctgtctggctgggttgggtgcaagcaggctctgaatgcctggcatttcagctgcatcacctcccagctccttattgcccaaatagagagggtggccctggctcccctccgagcaactctgcatttaattttgtaatctgggaagtgcctggttttgaaaatccgctttctctcactcttcccctccttccttgcccctggctgctctagtgttctgtctcccagtcacctcgctctcccagcaccagtgcccttctcctgctcccagatactctttcctttcctctctcctgttttccttcctctgctatctctcacacctctcccagactatgtcatcttgttctcctgcctgggttcaaactctgcatccttctctaacaacgtgactacctcatgtctgcttcaaggcccccgtgcccttcctgtatccgcggctgccgcgcactcgcctgccatcctcctgcctcctcttcactcagtgcttctgcttgccctgccccaggcagcccacccacgcccagtgcgggtgtggagaagatcttctggcttccctgcatcttgcctttgggattgggatccaagggttctccatggatggatccaagtcatagaggggaatgtttgagacagggaagggggctgtgatccagaggctcagaataaaaagatgccctcccttctatgcaggggggcaagtttactggatggagatgatttgggcctctcttccagaagaagctaaaggaagagaaggggagtgagagttcagggaggcccttcccaccctgtgaggcttgacttgatctggattggggatgacaggaatctcaccctctggggtgctggcaaggaggtctttgcacaggaaaaggggtagctcatttcagtttgttttttctttaaattgaatcctcaagtcattttctgttcacctgccgcacagggacaagcttgacttctattttctgtgtagtgaaaacaatgtcatttatttggtttttcacctcagccctctcataggagcatagaatgttagggtctttactccctaatgatgtctgattggcacatcaagagttaactctgccttctgggccaaattcgaaataaccagtccatttttccttttttttttttttttttttaaatggtggaatgtctctcagcacagttgcggcttcctcaaaccctgaaagcatctgtgtttattatactcgggtgtcactcactgttgatgtctgcacctacgtttccacctcctccccctccttcagccagcctatgataacactaaagattattaatgttggttttgtatctcgttaaagacagaattgtcacttgtagtatttctgtagcattcagcgctgctgtggctaacaccactgtgtatgtttcatcattgctctgaaggtcaaaagcctcattttattttgctggtttgattttttttttttaaagaagaaaaaaaaactgccctgaattaaatggctgttttaacagtaggctcttagcattataccacatagtcatttttcatgttcttgtttaacaggcactgaggttctggtttaaattaaatagctgcaaatgagacaatttataacccattaggttgggtggaaaattgtttctcaaaagcaaataagtaataaatctggtatctgcctataactcacagttgataagaaagtggccatttctcactagcactatatatgatttgggctctgggtaatttggaagtgttaggtttgtgtctttgtagcagtatttttattagaaaagaatctattggccttttacagggtattaatccctttgtcacctaccattgatgccttaagttttctgagtctcaattaaaaatcttccttttcttgatgcatgacaagtgtaatcagtacttgctcatttatttgtctgtatttagtttatgctgtactatttaattatccttccagcgttttttttttctccttacaaatatgatactctttagtgttaagctaaggcattgattcatgtatctgtccttataatgaattaataaactattttccag

SEQ ID NO: 116 - DNA, 3144 bp, Homo sapiens
cagaacccaagggcttacctgtgctctgtgattccccaactagggatttagttgtagccacggacctggtaggcaacagggaggggattttaatctgctccttgcatcagaaggtccaataggcagggttagtataatgggagatgccctggtagggctggcaaggagaagaagccacatgtattttggtctgatgaaaagcagcagtgatctgtcactgaccaaaatggtcccccaactatgcattacggagcagcaacccacatacagaactcgagaagccacggcctggagactgtacctggacaccaaagactggagagaggagctggtggggaaaccccagagttcccagggtgccactccccagctccaccagagaactttgggaatgagctgctgcccctgagtgcccctctccagggcctcagtgagggtctctaccctccagggaggaacaaaaccttgccagctggggtcctgcgagagggggcagttcaattcctccacaggggactctgcaactccaatctttcgagtgaagcatctgcgaggccctcagggacccaggatgaactgcatagcagcagaaggaagacaggccagaccaggcgggagggagcccggaaacatctggtttgtagtttcagactctacccgttcacagttcacacagtctcaccgggaaactcacaccttgccctgtaccaagtttttaaggcagttaagctctgcccatccgagacttcatttttcttgagtagaaaatcactgaaatcatcagatccatggcacccaccttcactttctcctaacagctggaaccgtcaggctggcttcagggcctggtcttcgcacttgatatcactatccctcacctgctcagacagccagagcaggcgggtgagttcctcccaacaacctccactgcattctctcagctcccaccgcagggcagcccacgtgcctgagtgaacatgtgtgcgtgtgcacacacgcaagtatgcacagacatacactaaacacgaacatacagtgcacatgaacgctgctcccagctagggccctctggtcagactgctgcctgggttagaattcttgtccccacccccacttactatagttctgtgatcctggacaagtaactgaatctctccgtgccacagtttcttcttgtagaaaacgggaaagttcacagtacttacctccttagagtcattgtgaaggtcagtttgaggcatcacaaatttaaggcacccagacataagggtcaacagggttagctatcactgtccagtttggtgggaggaactgaatgcatgtaggcacatggacccagtctacactcaggcacaaaaggagctacattagttacattcaggcataccccagagcactacaattctctgagacattgtctggaaatctagaaatcatctccttgccctttaaggtattttaaccctcgcattcctctgcttttccaagaatgtgaatcttgccaagctgtccgtgagagacacgggctcccctcgagggagacttgcaaatgctccataaacagccacagtgtggggctctgccatgaggaagtcacagcagacacgctagacagcatagtcctggatgcaacctggaggaagggaggcccatggtggagcactcactccgtgcctgtctgcccggtgagacctcaagttccttgcagacaaaggccatgggttgttggctcttgtgttcccggtggcctttccagagctgaacagaggacagatgcacagacgggggggctctggtggtcaaggcagcagtccccttggatactaaagtctgagccaggcccctcaggcccggcatgggcagtgcgaggcccatagtggtgggaagccagttggccagctggggtgagaaggccgcgaagccatgggcagacaggaagtggaggtgaatgtctctgcctcctgtaggcctcagcagggacagcacagaccctctggctggggcagcgcagaccctctagctggggcagaacaaggctggtgcttccttctagtccttgagactttgtagctctaactcaagcagaaccctggggttttgggattctgtgtggtgactgctgaggaaggtttatggatttgacagggtgcatgtcacagagagacagttctcagtcagcacttcctgtcccctgcagaggctcataggggacagcccctgccaaggagaccctggaggggctctgaggatagcaatcagaggttgggctggctggactgagcccaggcctgttgcccaccaagtctccataggttctagtctgacccctctctccacccctgggctatgcaggccagcccgtgcagaccacccccgacgcgtccacttgcaacacccgcctcactgtgccaacactccatccacacaggaaaggactgagaacgtgatgcttaacccaaaggagtgagtttcataggatgggtggctttaacagtttcacagcaggacactgagggaatatttccctatcccttcaaatggacggtcactacagaaacgtgtagagcaagactttgtcaaggggctgtttccaggtctcccggtgtctaaatagcagagctggaatgggaactgagaaccgattctttccacaaccgcccactgagcagcaaggctgcagccagcaaagaggtgcggaggcaagcaagctccatgtggtggggacagcgcattgcgacctccaccacccctgcagtgggctgccagctgagccacctgtcttccactgtatctactgtacgaacttctccagctctgctctgttttctcttcctcagcatccaccccgtgacacgtagtggtggctgatgtcgccacagtaccatgaggttaacaggtcctccctccagcttccctcatggtggcagcctaacctgcattgcagccgttcaccggacaccgcaccagaccctcaaaacccatccaagactgtgggaggagtaaacaacccagcccagttaagaggagatgccgaatttaatgaaccctatttgaattgcagggctgtgattcctcttacctttaacgtgaactcacaggcggattaaagtgaaataaaacctaccatttgagttaaaaaaaaaa

SEQ ID NO: 117 - DNA, 1600 bp, Homo sapiens
acttcctgagccgggctggctgggtgggaacaggctccttgccgcctccccagcgctggccactaccacactgccgcccgcctgggcctcctttcaacctcgtggtggagccctgcggtttcccagcggagccgggcccggggctgctccctcgcgggcgaggctcacctgtcccggcccggccccctcccgcgccccaggtggttcagggcggggaggagccgcgccccgccccgcgcggtagcagccaacgccggccccaggcgggtgcgctgggagcctgggccgggagccgggtgagggcgccgagaggctcggtgggcgcgggcggcgagatatgccacacttctgcctgctgttggcaaccctcctggactaggctgctcttgttaatcacatggatgttgctgattactctgagtgcaaaccttttcactgttccagagaggagcctgacaaccacattctccttctcaagatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcgactgtacgaagaaaacttccagtggaactaatatgaaatctatttgcaaattatggggggaaataaagcttttaaattatacaatgaaaaaaaaaaaaaaaaaaaaaaaaaaa

SEQ ID NO: 118 - DNA, 2293 bp, Homo sapiens
agaggaggctagcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagcttccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattgggaaaaaaaaaaaaaaaaaaaa

SEQ ID NO: 119 - DNA, 4184 bp, Homo sapiens
atttaagggcccgcctctcctggctcacagctgcttgctgctccagccttgccctcccagagctgccggacgctcgcgggtctcggaacgcatcccgccgcgggggcttcggccgtggcatgggcgccgcgggcctgctcggggttttcttggctctcgtcgcaccgggggtcctcgggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtgttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctgtgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaaggctgccagtcacctcctgggctccaccatggtcgtcatacaggtggaaatacggtcttctttgtctctgggatgactgtagactacacttgtgaccctggctatttgcttgtgggaaacaaatccattcactgtatgccttcaggaaattggagtccttctgccccacggtgtgaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggcatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatcaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagcacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggctttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacatacaaaaaaaaaaaaaaaa

SEQ ID NO: 120 - DNA, 3095 bp, Homo sapiens
attgctgatggatcagtgagcctgtgttcatgccagtgagctgctgtggctcagatactgatactttctttccaaacagcataagaagtgattgagccacaagtatactgaaggaagggctccctcgagttctggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcgaaatggaagcatcgttgctgggtatgaagttgttggctccagcagtgcatctgaactgctgtcagccattgaacatgttgccgagaaggctaagacagcccttcacaagctgtttccattagaagacggctctttcagagtgttcggaaaagcccagtgtaatgacattgtctttggatttgggtccaaggatgatgaatataccctgccctgcagcagtggctacaggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattaccattgctgtcacgcaacctagcaatacctacaaaaggaaagatgtgtgttggcttaactggtccaatggaagcaaaccactcctggcttttgttgtccctgcactggctattgtggctgtgaacttcgttgtggtgctgctagttctcacaaagctctggaggccgactgttggggaaagactgagtcgggatgacaaggccaccatcatccgcgtggggaagagcctcctcattctgacccctctgctagggctcacctggggctttggaataggaacaatagtggacagccagaatctggcttggcatgttatttttgctttactcaatgcattccagggattttttatcttatgctttggaatactcttggacagtaagctgcgacaacttctgttcaacaagttgtctgccttaagttcttggaagcaaacagaaaagcaaaactcatcagatttatctgccaaacccaaattctcaaagcctttcaacccactgcaaaacaaaggccattatgcattttctcatactggagattcctccgacaacatcatgctaactcagtttgtctcaaatgaataaggcaaggaatcataaaatcaagaaaaaatttccagaacaacttgacatttagagacaaatgtcaatgaagaaattatgctcagtattcgatcgggttttctgatttaggggtctgggaataaaacaagaatgtctcagtggcttcaaaaaaaaaaaaaaaaaa

SEQ ID NO: 121 - DNA, 2701 bp, Homo sapiens
agcctcggggagcagcccgggctgtttgttccgtcaccggggaaaggaggtacacacagtcgcgcgcgcacggacacacacacacacgcacgcacgcacacacaccggtggcgagttcgagccccgcggcccctgtccgcccgcgtgcgcccctcgacacagctcgcctcccgccccctgattcctgctgctgccgcccagaggagaaaggaacctctgcctcgaatttccccactgcgccgggcgctgcggagagcggcgagggtgggcgcgaggcggagaacgcgatgaatgagttctcccctcgcctcggagttgtctgagttggcggcgctgcgcccaggcttccggctctcagcgccccacgcgcgcgtggctccccgggctgccacccacgcccgcggccggggccgagccagccacgcagggcagccgaggctccggagctcctgtcccggccccagtccgggtaaaaggagggttgtccccagcggaggcgcacagccgcgcgttctccctgcactctcttcgcggtcccatctgttccccatggcgtctcatccgcaaacccggatccaggcttacctggagaagaacaagatcggtcccctgtttgaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagcttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctggaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtgaaacagagagaagaagttgcaagtggtccttaaagaaatgcagttattcaaatccttatgtatagttctaattttatttactatgtgtaatcatttagagaatggttatttttataatctcaataataaacaagtactatcgtagccagggggtgcccaagtatgtaatcagagaacactaatcctggcaaaggattgtggggtggtcaggaggccggctgccttttgacatggttagagtcctgggtttagattactttataaatagttattaagattaatatttgatatattaaatattgcctgattcaaataactttgcttaaaatttttctgtattttaacttgtctagggttttctacttcttctatttttataatattttctcattttttagattactaaacattctacttatccacatgtgccaagatgtgccatttaggtctctgcagaaattagctgtttggtatcatcacctgccatacatgttgtgtgcagcagtgagaagtatattctctaccactgctctttctcatgattattttctctattcctattaaaatgaataattgatatgttaattaagtaaagcaaatcaataaggaatgaaatgcatggcccaaaacatagaaaatgaaaatcgtttgaccatttatccaattattgaacccaattaagatgatccattttaaatttaatatatgctcgcttttggaatgtgttatgcattgatgttaagtgaatggatctaagtaaatctattgatatctctacaaaaaaaaaaaaaaaa

SEQ ID NO: 122 - DNA, 5218 bp, Homo sapiens
attggttgcggcggatgcctcgcgggccggtggctatggaggcggcggcggttgatggttgaccgttggctccggggtgggggtcgccgttcgagtgatctgctcagacccgaccagagggcgcgggctgctgatgcttggcttggagcccgtgggggagacctagttcggctccgccatgccggccgccgggagtaacgagccggacggcgtcctcagctatcagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtacgctccatggtgagtgactttgctgttttcctcactatcttcacaatggtgattattgattttttgattggagtcccatcaccaaagcttcaagttcccagtgtgttcaagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagtttattccaatgccagtactctacggagttttcctttacatgggagtttcttcactacagggaattcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcatgcctgaaagcaaaaagaagaagttggatgatgccaaaaagaaggccaaggaggaagaggaggctgagaaaatgttagaaattgggggagacaagtttcccttagagagcaggaagttactaagtagtcctggaaagaacatcagttgcagatgtgacccctctgagattaatatatctgatgaaatgcctaaaactacagtttggaaagctctcagtatgaattctggaaatgcaaaggaaaagagtctcttcaactaagagtctttgctgggatggaagatttgggccgtgtggtgcctcagggaagttctggttacagagaaaatggcgagtctctcagagaagaagcaagaccaagtctggccctgtccttggtcatctcaaagccatgccgaagcattcagttattcttggtgtgcattggaaggcatccagctatccccataccagcagccagtcaccagatgtgaatgtggaagcagaagaccacctcctgttggttcttctcctcttccttctttttctctttagaacggccaccattgaagacctagcttcccattttccagacgttttctctgaaattctctgctggcctgccaagccatatggattcattctgccactgaggagtccttcagtgaggtccctcttcctaaaggacagagtggggagtaggaggggaacagagaggacatcctctctggctctccagtgctcttagtgtctacaggctcctaggcagccctgggccttggtttgattacctcccctgggggatgctggtcagacccagaggttgtcaggaggtcagctaccaggaagatccatgatctgggcattggcagtgcctgccaccacagccaggaagatgcctctgacctgggtgcatctccatcactccttagcagcagcctgcataactggcaagaatcttggatgatacaagagccaagaagggacatttgagttgtgtcgcttagataggaaagggatccagggaaaatcaacagtaagtgaggatgagcagtgtctcttggttttcattgaggatagagtaagagattgagtttagattgcaacagaaggaattagtttagataccaggaagaacttcctagcctgaagatttgtcatagtgtctgctttctagatatctgggaaagatttgataatagttgtttgtgaatagaaaggaggatatgatgtttttattggccattttgcgggactcttcgacttcttgctgctgtctcttgaggatacattccaattccatcctggcgagatccaagtgcttacgtactgtctccttagctgccttagagtaaacgatcatcagttcaatggaccaaaatcaccttcagccatgtggtttcttcatcatcatggatttcttttggttgacaaacattctggctctcagatgcaaaaagtcacactgggaaatgaactgtaagtggtgaaattagttttggtatttaatttaaaactacatttatagtttttctcttctcttctatgttgcaatgaatgtaaagtatttgggatccagtgcttataaacctttccttcctttgtgcacagaatgtaactagcaagcccattagcacccagataattctatcatgttagtttcccatcctggaaaatctttgtacagtgggaagttccccgatgtgtttttctttcttaggtgaagggttggctatatcactttattgaattttgcattccttagacttttaaaatatactaatgtattctagtcttactctaaagacctttgatgttaaaggaatccttcatttatttcatattccctatctcatagggccacaattattttaatacagagatgattttcaaaatattttaacaactggtacaggacagatgccagccactcagaagggatgcctgctgtaaacaagcagtatgtatggttgtaccaatgcctattggctgaacattatgctactttcagatattaaaatggtgttcctttgaatcgtg

SEQ ID NO: 123 - DNA, 2523 bp, Homo sapiens
gctgagcaggagatgggaattgaaacctgcgcagaggcggctgtgcagggtgagagtggagccgaaaccacagaaagtgaagtttgcttcaacgtcttgtcccggcaggccactcagatgtgagagtgaggaagtgggatggggcctgaccggaaggaggtgcccctgagccgaggaacgcaggcggtggtcgtggggaagggaagaggagccccgggagacgacagcagcatgggtgggcggccttcgagccctctggacaagcagcagcggcagcacctaaggggtcaggtggacaccctgctgaggaacttcctgccttgctaccgtgggcagctggcagcgtctgtcctgcggcagatctctcgagagctgggccctcaggagccgaccggaagccagttgctacgcagcaaaaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcacagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaagaaattcaaatcggacagcgggttggcgcagaggaggttcatccgaggctggggtctctgcatctttttaccttttgtgctgagccaactcgagccaggctgcaaaaaggagctgcctgagttcgagggggatgtccttgccgtgggcagccaggctctgaccactgagggcatctatgaggacgtcatccgggggtgcttgctgcagaggattgaccaagaattgaaaaagacccttggtgccaatgatgtatcctgcactctggacggctgcttggaggtcccatgggaacaggagggagcagctccaaatcttaacttggtgtcaagtttcctggctgggagacaagcttttaccgacttcctctgcttgccagcaaagtcatctgctaactggatattggcagcttctctgctgtcttgcagctgcttccggagtgggttccacagggattcccgtgtgttcttggttcagcttgcagagggactttcacactccctggagaccgtttcctcccattctgtctggagttttcggcctaccccaagacaatgagatattcctgacctttccacctatttccctccaaccccaccttccgaaatacatttgctcaatacatttgcacttcataggcttctttagctgtcttccttttaccccggacgggatgtagatgttaattctggaacaattgcagctacaagaatttgtcatcctgccccttttgagaaaaacattgtttgcccttgggtctaaatccttccagatgggatgggatgtatcttgtcacctcctttttcttacttaatatgaaaagacctttcctcaaaaaaaaaaaaaaaa

SEQ ID NO: 124 - DNA, 3588 bp, Homo sapiens
gaatctgccggtggggcgtgagcgagaagccaccaaaacatgagctaggacagccttctcaagaagattctgccaactcaaaaatattattcttttttttttttttttgctgttgtttctgagaaactaggtgtcttaccattttaaaatttcatattttatttaaaaggaaaccagtgaattgaaaatgagactaaatatcgctatcttctttggagctctctttggtgctttgggggtgttactctttttggtggcttttggatcggattattggcttcttgcaactgaagtggggagatgttcaggtgaaaagaatatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttatttaccgtggtttctgggcagtcctgatgctcctgggggtagttgctgtagtcatcgcaagctttttgatcatctgtgcagcccccttcgccagccattttctctacaaagctgggggaggctcatatattgctgcaggcatcctattttcattggtggtgatgctgtatgtcatctgggtccaggcagtggctgacatggaaagctaccgaaacatgaaaatgaaggactgcctggatttcaccccttctgttctgtatggctggtcatttttcctggccccagctgggatatttttttctttgctagctggattactatttctggttgttggatggcatattcagatacatcactaaatcaactgttgccacaagtattttcttgagagattttaaaacaaggaatactttttttccattttgtttcattgatcccagcataaagttagtagatataactttttagttgctattcaaattaatcattttactaaaattttcttcagtaagaaggtcctagaatctctccagacaccagcaagcctctatcttgtctaagtgctgtcaaggacctagttctttagggaataggtaaacaggtctccctttcattgaacatgttagagttcatgcaggtcgcaaaggcctgataatagcttaataccatgacatggggaaaatctcgatagatttggcttaaagtctccttggcattcacttctgctaattaaaaaaaatccttgaagaataattaagaatgggcaaggttgtcagagaatttattttgtttcttgcccacacagataatatccacatacacattcactggctcttgtgagcaaatgaatttaaaaatagacagcagttgttctaattagtgggagccatgtactcaccagttaaaatgggccacaacaaacaagactgagagcatgtacttatcttgctttttcaccaacagtggtttggttacctagttttattcacttaattgtgcatgcttacataaactttaaactacatttaaaactagcaaatctgcataccaaattatgtataacgtagattgaatttttatgaacttaaagtgagttaattgtataatgtaatattgtttaaaatatgtaaaaaccaagcatttccgcttggtccataattctatttgatattttaaaattctcatttaaaaattatattgctatcattcagcatgtgaaaatttattgataaaatgtgattttaatattttttagatataaactttcaacgtacttccatatgaggattataatagccctgctttattaaagaccataaaatattaactttccccaagatgttatgggttccagttcttctgatcatttgattcctttaattactgtccctcaatttcttcatctttacaatagatatattaacatttacagatcgactatttcctttaacctcctagaagaaagtttttgtggggaaagatgattctgtattattcagtagcatagacattttgcatatcaaagatgttcatttggcactaatgttgattgaaatcaaatccatctgagatgcctagctcgtatttgcattctggaagcctccatcgcaggggagctcggcagggtatgtgagctttgttggaggtgcggtgtttcattctgcagctgttgtgaggacagagaggcatggcccacaggcaaaaaaagtcaccacccagaagatgctctgggatagaggaactgctccttttcatcagctcttccaatgccgtgggagaggtgatcccagtcttctctgtacatcttgtgcttttccattaagacttgttccagtgggaaggagctttggaaaaattgcaaaggtctgaatcttcagggcattttcatgacaggacttgccaataataataataataataataataataataataataaagctccagaggcctaactggtttctcaagtcatttcagtgatatcattgaaacgtttttgtggtacttccctttgtctttcactgtttcatttttatattgcttcatttacttctttgcttttggctttgttattagaaaaaataattatgaggtctgttgtgcatgttgactgtgatattaagttatggcatgccattaagttttccagacgatgttggatgtatctgattagttcatgtcatctgtaaatacaattcttttttgtagtactttggaatggagcctttttctggtgtactgtatgccatttaagtttcacatacaagctgctttcggcaaaggcttgaatatttataaatttcagatggttatcctcactttatagtacacttaagtggctaccatatattttttatatgacaattggctgaatagctgatgtgtatgacacttttacacagatttgcactttggaactattttatagttgtaatgcatcaatcaaatacatttcaagcacatttcttgatcaatttaccagcaaccctctgaaggaatgaaggagagttgtgattgctatgtcaatgagtgaaatatacttaaaaatggcagagttatatagtacattattgtagcaaccttatatctgatttgagatactgtgttgccaaatgtccatgttatgtttatttctctattggttgtatttattaatttttagaagcctttaaactgtgttagaatctttttgaaaaatgttgattttgcatcataaagtttcaatttatcaaggatatcttttcagttacacttttagaaagagtgaataaaaagggcagtgagttatgctcttggacttggtgaaagctatcatctctccatattgtatttgttcagctggtttaattcactcaggtggatgattgcacatacattggaattggctggagagactacacagagaagtttaatgatcgtgtacaatttgagggttgatggtagggctttctaaaaaaagtaatatcaagtgtgttgttagtattcatttagtcatttttattactaatctataaatatatttattaaatttgaagattaaatggaattataaaggaatatattggaggaa

SEQ ID NO: 125 - DNA, 3095 bp, Homo sapiens; identical to SEQ ID NO: 120

SEQ ID NO: 126 - DNA, 5834 bp, Homo sapiens
gccccgcccgcttggcgcgcgcccccgccaggtccgctctcgtcccccacccctggcgcggacggggtggttccagctcactctcctcccccgagcggcagcggcggcggcggcggcggctgctgcgggcgctgaatgagagacggtgactgttcgggtcgacgagtgctactctaggcggcggcggccgtggcggtgaagcgtgaggccggcatcgtctttccgtcctctgaggcgacggccgcggctgcacaggaataatgtatttgtggccttggacatgaggcagtcagtcctctgttgctgttaacataaggtcagggactgatgaggaaagcatggacctaatgaacgggcaggcaagcagtgtcaatattgcagctactgcttctgagaaaagtagcagctctgaatccttaagtgacaaaggctctgaattgaagaaaagctttgatgctgtggtattcgatgttcttaaggttacaccagaagaatatgcgggtcagataacattaatggatgttccagtatttaaagctattcaaccagatgagctttcaagttgtggatggaataaaaaagaaaaatatagttctgcaccaaatgcagttgccttcacaagaagattcaatcatgtaagcttttgggttgttagagagattcttcatgctcaaacattaaaaattagagcagaagttttgagccactatattaaaactgctaagaaactgtatgagctgaataaccttcatgcacttatggcagtggtttctggcctacagagtgccccaattttcaggttgactaaaacatgggcgttattaagtcgaaaagacaaaactacctttgaaaaattagaatatgtaatgagtaaagaagataactacaaaagactcagagactatataagtagcttaaagatgacaccttgcattccctatttaggtatctatttgtcagatttaacatacatcgattcagcatacccatcaactggcagcattctagaaaatgagcaaagatcaaatttaatgaataatatccttcgaataatttctgatttacagcagtcttgtgaatatgatattcccatgttgcctcatgtccaaaaatatctcaactctgttcagtatatagaagaactacaaaaatttgtggaagacgataattacaagctttcattaaagatagaaccagggacaagcaccccacgttctgctgcttccagagaagatttagtaggtcctgaagtaggagcgtctccacagagtggacgaaaaagtgtggcagctgaaggagccttgctcccacagacaccgccatcccctcggaatctgattccacatggacataggaagtgccatagtttgggttataatttcattcataaaatgaacacagcagaatttaagagtgcaacgtttccaaatgcaggaccaagacatctgttagatgatagcgtcatggagccccatgcgccatctcgaggccaagctgaaagttctactctttctagtggaatatcaataggtagcagcgatggttctgaactaagtgaagagacctcatggcctgcttttgaaaggaacagattataccattctctcggcccggtgacaagagtggcacgaaatggctatcgaagtcacatgaaggccagcagttctgcagaatcagaagatttggcagtacatttatatccaggagctgttactattcaaggtgttctcaggagaaaaactttgttaaaagaaggcaaaaagcctacagtagcatcttggacaaaatattgggcagctttgtgtgggacacagcttttttactatgctgccaaatctctaaaggctaccgaaagaaaacatttcaaatcaacatccaataagaacgtatctgtgataggatggatggtgatgatggctgatgaccctgaacatcctgatctcttcctgctgactgactctgagaaaggaaattcgtacaagtttcaagctggcaatagaatgaatgcaatgttatggtttaagcatttgagtgcagcctgccaaagtaacaaacaacaggttcctacaaacttgatgacttttgagtagaagcctgagaaaaaaagagaggtgaactgttgcttctacgtgagcatgaggacctgataaaagagcgccagctataaaccatcctgtgccaggaagagcccagaggctctgtctcagtcgttggagttctcaaccaaaaaagcactaatttcagggaatgatttgagatattcccagagaacaaattggagttgcaaaacaaactgccatgaaccatgcttcttatctcagaactgacctgtggaaaccactgccttaaaagaatgaaaggaaaaccaacatgaaacaccaaatagtgtgtgtgaatcttctggcggtgctgtgcttggaatagatcgtagctaatttgcatttcttttaactttgtaataattttagaggggggaattgccttttttagatatgctttaaaaaggaaaaacatactcttgtggattccatcaggagctggttttgaaccgaggtgaagagacttagcagggattgtaccagcagcccacctgcaaggtttgttctccctctagtagtctgcaacctcactggctttctcacagcaagagtgtaggaatgagaaatgttagtcatgtgagttcttgggtttgtttgggattgggtgggggtgtttgttttgttttggatgaggggagaatttttttaaacactaaacttctgaaatgtagtactgtaaggggaacattatttcctgcaggaggtacaaaggctgtgtgttcatttgccagacgctttttttttaaataggttccagaaaacatggttgtttctaactagggttaaagtttagctttctatatgaattcattgttggaccacagatctgcttaagtaaagagctataatcccaacctaaacttttctgagattttacaataattagatctttttccaagttaattgggttttcccttctcccagtcataggtggtttttatcatcaagacagactgatattttgtcaggatattttcttttacagtgtttgatgtgcataatgccagagttatttttttattattcattttctctctttttgttcaatatgagattcaggatcatatttgtttaaaaggtaacacatagagatgtatgtatatattttgttataagacatacaaaataattttaagagggataaaggtgaaaatatcagattctggaaattttaagtatctaaactttatacttgtatgatttaccataaacataccaaaacatttttctgaaaatttactgtcggtctctgacatgaaaccgtattttgtcagtagttgaccaagcagttttatgagaactcttctatgcaatgatgcatttaatttctaaagtaaatgttgaattattaaaaaaaaagtttgaaggtaagatgccttagaattttaatgaaaaatgacactcaaacaaaggctatatgtcgaatgttataaactcttgagacataatgaattttagcagtggcctagagtaaggtaatgctttgtgactgatatctactaatagacttctgttactttgggcctcacataaaatttctcacattcgtattcttagagaattttatacttttttattataagtattttgcccttgagtccatgaaacttcaatagaaaatattgcttatacaataattagcttaaaatccatccaaaggaaaagagaagagctttttttgagtgttaagttttttaatttagtattctgtttggaaaagatgttaagagttcaaatatgcttcttatgtaacagaaataccattatttctggggtttagtgacacaggctggagaggacaaaagtttcctgtcctgaatgatttttcaattaatgctctaagcttaacccatgttgggtaatagaaagacatagccagcagtattactacgtagaccttgcacatcttacttttgttttgcatttttaaaaatttcttaatttgtttatttctcttcagaaatagcgtttttaacagtgtatgtgcttttttaaaaagtattgtgaatgagaaccctgtggattttttttatttcatttgtttgtcataataagctaacgtagaaatgttgtaggttaaccatatctgtggaaatatgcagttggaagtcagagcctgacatcacatagttttgccaaagggagagagctaagctggaagatgtttttgatactttcggctctaaacattaatggatgtttgcgtagagtaagatagcgttcaaatttggttaatagtttatagatagacttgtggcctctgactgactaaatttcttaacagcacagaagtcgttgtttttctgtctttaaaatttattcattcagaaaattagtcattgctttttaagattattttagcatttgaagcaaattgaaaacagaaaagtgacttaaaatagtgtaggtgaattttttatctataatttaccaaataatacctgataataattcaaagaaaatatgttaccaaaatatattaaatatataggtagttcattcgtgggaagatgaatcttcttattaagcctgccctcaattgtaaataagtgactcaaaaactcaaaatgttcatcagcattcaggtcatttgtttcacccttagccaagaagaactcattagaaattcagttataatttcaatttaagcctgtttatgataagcataatgattggcatgttatatagcctgttgaaaataactacagaatgaccttccagagcactgtttttggcctcgtgcccgctctgttcaggctctgcttgtttttcagaatatgatttttacctccagacagtaagaattgaacaagaactgatcaaacacaccttcctattttgttttcttcactatgtaaatattatttgggcaaacattacaaaaagggatccaaacaatttgagtttcagtatttttttctccctaggcatgtgcttcaatttcaaatatttttttctgtgtggaaaatgccatgtaactattgcactaccttctgtgtggactgtgttggtattggttctttctgtatatcaaaagtcagggtgtttataactgcaaagtttgtataagtggctttattcctcttctagaagatttatgaggagcctaggaagcactattggtacaggaggaaaaaagaatggaaaacatgtttacagactctagctttccttattagcttaaactggggccctcaaagagcagcctgttgatcttttggccaaatgacttgagcataagtcttttatttctttttaaggttaaatcgtaaactgtatacctttactactgaaaacaaaactatagggcatcatactaattgaaaatcaatagtaatgggttccatccattagctttttaaatgaatagatctggtattgatttccttcctgtttttttgaggcacattcctttacaaccagtgtttaaaccaccacgtaatcatcttctgcaaacaaggggtgccagtgttgcctaacagaagataatctttaataaagcaaatcctctgcttcaaaggtttttgaaataattggatccctttttgaaaaggaagatgagtttaactgtgtccaggtggagtaatagtactgctgttgcatgaatagatgatacaaagcaagtgatgaggttggtatgacttctttagtgaccttttagggtttgcttttattttcctctcttttttgtattatttctttcaaacatagtaaatatatgattttacagccaaa

SEQ ID NO: 127 - DNA, 1082 bp, Homo sapiens
agagaggacatcatggaaaaagtcagactctttctaggatttgaatcgggagtctgaagaggagaggggtgaatgtgcaagcccttaaccaccccacatcactgatctggaccagagaacctgcttggaagaagtgagaagccatgctagcgaaggccaggagcttgcaggggctcagagcctggcagttgcattagtttgctgtgatgcacagtgcaaagaggtggctggtcaaggaccagtggcatggtgaagtgtctccagggtgcaccgcttttgcggcagtttagtatggacagagtctgggcaggctcagtgtagcaagcctgtcatgagaggtgaggaccaaggtggaggttggtgtgacaggaacaaggaaagggaagaacatagagcaggaacacaggagaacaaagaaaggtcaggaccgtcagcctccaaaggccactgaggaagaggggccatccactggaatggaaaacgaagacgtacctgtggggaaaggatcttaaattcagtttaacagagcaggccttcagcaaaagcaagaattcttaatttcaggtaggaagatattagcagtgtcttctaatatttgttttcggaaagatttatgtcattttagttcacacaactctgtctgccagcatcattaacttacctaacttgtttagaaacaaaaatgctaacagcaccactgagaccttgctagtctaagtgtgctttggagaccattggcatcagcaccatttaggcacttgttagaatgtagagtctccgggccaggtgtggtggctcacacctgtaatcccagcactttgggaggccaaggcaggcagatcacatgaggttagaagtttgagaccagcctggccaacatggctaaaccctgtctctactaaaaatacaaaaattagccagacacggtggcacacgcctgtagtctcagctatttgggaggctgaggcaggagaattacctgaacccgggaggtggaggtagcagtgagtcaagatcgtgccactgcactccagcctgggtgacagagtaagactctgtctccaaaaaaaaaaaaaaaaaaa

SEQ ID NO: 128 - protein, 798 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 129 - protein, 614 aa, Homo sapiens
MSGIKKQKTENQQKSTNVVYQAHHVSRNKRGQVVGTRGGFRGCTVWLTGLSGAGKTTISFALEEYLVSHAIPCYSLDGDNVRHGLNRNLGFSPGDREENIRRIAEVAKLFADAGLVCITSFISPFAKDRENARKIHESAGLPFFEIFVDAPLNICESRDVKGLYKRARAGEIKGFTGIDSDYEKPETPERVLKTNLSTVSDCVHQVVELLQEQNIVPYTIIKDIHELFVPENKLDHVRAEAETLPSLSITKLDLQWVQVLSEGWATPLKGFMREKEYLQVMHFDTLLDDGVINMSIPIVLPVSAEDKTRLEGCSKFVLAHGGRRVAILRDAEFYEHRKEERCSRVWGTTCTKHPHIKMVMESGDWLVGGDLQVLEKIRWNDGLDQYRLTPLELKQKCKEMNADAVFAFQLRNPVHNGHALLMQDTRRRLLERGYKHPVLLLHPLGGWTKDDDVPLDWRMKQHAAVLEEGVLDPKSTIVAIFPSPMLYAGPTEVQWHCRSRMIAGANFYIVGRDPAGMPHPETKKDLYEPTHGGKVLSMAPGLTSVEIIPFRVAAYNKAKKAMDFYDPARHNEFDFISGTRMRKLAREGENPPDGFMAPKAWKVLTDYYRSLEKN

SEQ ID NO: 130 - protein, 220 aa, Homo sapiens
MPLTGVGPGSCRRQIIRALCLLLLLLHAGSAKNIWKRALPARLAEKSRAEEAGAPGGPRQPRADRCPPPPRTLPPGACQAARCQADSECPRHRRCCYNGCAYACLEAVPPPPVLDWLVQPKPRWLGGNGWLLDGPEEVLQAEACSTTEDGAEPLLCPSGYECHILSPGDVAEGIPNRGQCVKQRRQADGRILRHKLYKEYPEGDSKNVAEPGRGQQKHFQ

SEQ ID NO: 131 - protein, 506 aa, Homo sapiens
MRDPLTDCPYNKVYKNLKEFSQNGENFCKQVTSVLQQRANLEISYAKGLQKLASKLSKALQNTRKSCVSSAWAWASEGMKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGLERMLKTYSSTSSFSDAKSQKDTAALMDENNLKLDLLEANSYKLSSMLAELEQRPQPSHPCSNSIFRWREKEHTHSYVKISRPFLMKRLENIVSKASSGGQSNPGSSTPAPGAAQLSSRLCKALYSFQARQDDELNLEKGDIVIIHEKKEGGWWFGSLNGKKGHFPAAYVEELPSNAGNTATKA

SEQ ID NO: 132 - protein, 328 aa, Homo sapiens
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGQEKVIFPTLFMGQ

SEQ ID NO: 133 - protein, 1113 aa, Homo sapiens
MFSQVPRTPASGCYYLNSMTPEGQEMYLRFDQTTRRSPYRMSRILARHQLVTKIQQEIEAKEACDWLRAAGFPQYAQLYEDSQFPINIVAVKNDHDFLEKDLVEPLCRRLNTLNKCASMKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQVGLFRKSGVKSRIHALRQMNENFPENVNYEDQSAYDVADMVKQFFRDLPEPLFTNKLSETFLHIYQYVSKEQRLQAVQAAILLLADENREVLQTLLCFLNDVVNLVEENQMTPMNLAVCLAPSLFHLNLLKKESSPRVIQKKYATGKPDQKDLNENLAAAQGLAHMIMECDRLFEVPHELVAQSRNSYVEAEIHVPTLEELGTQLEESGATFHTYLNHLIQGLQKEAKEKFKGWVTCSSTDNTDLAFKKVGDGNPLKLWKASVEVEAPPSVVLNRVLRERHLWDEDFVQWKVVETLDRQTEIYQYVLNSMAPHPSRDFVVLRTWKTDLPKGMCTLVSLSVEHEEAQLLGGVRAVVMDSQYLIEPCGSGKSRLTHICRIDLKGHSPEWYSKGFGHLCAAEVARIRNSFQPLIAEGPETKI

SEQ ID NO: 134 - protein, 834 aa, Homo sapiens
MKYKNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVITPVRTGHGYVYEYPSRYQKDVYDIPPSHTTQGVYDIPPSSAKGPVFSVPVGEIKPQGVYDIPPTKGVYAIPPSACRDEAGLREKDYDFPPPMRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAKGSRDLVDGINRLSFSSTGSTRSNMSTSSTSSKESSLSASPAQDKRLFLDPDTAIERLQRLQQALEMGVSSLMALVTTDWRCYGYMERHINEIRTAVDKVELFLKEYLHFVKGAVANAACLPELILHNKMKRELQRVEDSHQILSQTSHDLNECSWSLNILAINKPQNKCDDLDRFVMVAKTVPDDAKQLTTTINTNAEALFRPGPGSLHLKNGPESIMNSTEYPHGGSQGQLLHPGDHKAQAHNKALPPGLSKEQAPDCSSSDGSERSWMDDYDYVHLQGKEEFERQQKELLEKENIMKQNKMQLEHHQLSQFQLLEQEITKPVENDISKWKPSQSLPTTNSGVSAQDRQLLCFYYDQCETHFISLLNAIDALFSCVSSAQPPRIFVAHSKFVILSAHKLVFIGDTLTRQVTAQDIRNKVMNSSNQLCEQLKTIVMATKMAALHYPSTTALQEMVHQVTDLSRNAQLFKRSLLEMATF

SEQ ID NO: 135 - protein, 308 aa, Homo sapiens
MNPIVVVHGGGAGPISKDRKERVHQGMVRAATVGYGILREGGSAVDAVEGAVVALEDDPEFNAGCGSVLNTNGEVEMDASIMDGKDLSAGAVSAVQCIANPIKLARLVMEKTPHCFLTDQGAAQFAAAMGVPEIPGEKLVTERNKKRLEKEKHEKGAQKTDCQKNLGTVGAVALDCKGNVAYATSTGGIVNKMVGRVGDSPCLGAGGYADNDIGAVSTTGHGESILKVNLARLTLFHIEQGKTVEEAADLSLGYMKSRVKGLGGLIVVSKTGDWVAKWTSTSMPWAAAKDGKLHFGIDPDDTTITDLP

SEQ ID NO: 136 - protein, 442 aa, Homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 137 - protein, 288 aa, Homo sapiens
MAAAAYVDHFAAECLVSMSSRAVVHGPREGPESRPEGAAVAATPTLPRVEERRDGKDSASLFVVARILADLNQQAPAPAPAERREGAAARKARTPCRLPPPAPEPTSPGAEGAAAAPPSPAWSEPEPEAGLEPEREPGPAGSGEPGLRQRVRRGRSRADLESPQRKHKCHYAGCEKVYGKSSHLKAHLRTHTGERPFACSWQDCNKKFARSDELARHYRTHTGEKKFSCPICEKRFMRSDHLTKHARRHANFHPGMLQRRGGGSRTGSLSDYSRSDASSPTISPASSP

SEQ ID NO: 138 - protein, 288 aa, Homo sapiens [sequence omitted]

SEQ ID NO: 139 - protein, 362 aa, Homo sapiens
MGNHTWEGCHVDSRVDHLFPPSLYIFVIGVGLPTNCLALWAAYRQVQQRNELGVYLMNLSIADLLYICTLPLWVDYFLHHDNWIHGPGSCKLFGFIFYTNIYISIAFLCCISVDRYLAVAHPLRFARLRRVKTAVAVSSVVWATELGANSAPLFHDELFRDRYNHTFCFEKFPMEGWVAWMNLYRVFVGFLFPWALMLLSYRGILRAVRGSVSTERQEKAKIKRLALSLIAIVLVCFAPYHVLLLSRSAIYLGRPWDCGFEERVFSAYHSSLAFTSLNCVADPILYCLVNEGARSDVAKALHNLLRFLASDKPQEMANASLTLETPLTSKRNSTAKAMTGSWAATPPSQGDQVQLKMLPPAQ

SEQ ID NO: 140 - protein, 1320 aa, Homo sapiens
MYATDSRGHSPAFLQPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSRCITVHGTNGLLIKDTIGFDTLGHCFFLEDGIEQRNTLFHNLGLLTKPGTLLPTDRNNSMCTTMRDKVFGNYIPVPATDCMAVSTFWIAHPNNNLINNAAAGSQDAGIWYLFHKEPTGESSGLQLLAKPELTPLGIFYNNRVHSNFKAGLFIDKGVKTTNSSAADPREYLCLDNSARFRPHQDANPEKPRVAALIDRLIAFKNNDNGAWVRGGDIIVQNSAFADNGIGLTFASDGSFPSDEGSSQEVSESLFVGESRNYGFQGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 141 - protein, 582 aa, Homo sapiens
MMNFLRRRLSDSSFIANLPNGYMTDLQRPEPQQPPPPPPPGPGAASASAAPPTASPGPERRPPPASAPAPQPAPTPSVGSSFFSSLSQAVKQTAASAGLVDAPAPAPAAARKAKVLLVVDEPHADWAKCFRGKKVLGDYDIKVEQAEFSELNLVAHADGTYAVDMQVLRNGTKVVRSFRPDFVLIRQHAFGMAENEDFRHLIIGMQYAGLPSINSLESIYNFCDKPWVFAQLVAIYKTLGGEKFPLIEQTYYPNHKEMLTLPTFPVVVKIGHAHSGMGKVKVENHYDFQDIASVVALTQTYATAEPFIDSKYDIRVQKIGNNYKAYMRTSISGNWKTNTGSAMLEQIAMSDRYKLWVDTCSEMFGGLDICAVKAVHGKDGKDYIFEVMDCSMPLIGEHQVEDRQLITELVISKMNQLLSRTPALSPQRPLTTQQPQSGTLKDPDSSKTPPQRPPPQGGPGQPQGMQPPGKVLPPRRLPPGPSLPPSSSSSSSSSSSAPQRPGGPTTHGDAPSSSSSLAEAQPPLAAPPQKPQPHPQLNKSQSLTNAFSFSESSFFRSSANEDEAKAETIRSLRKSFASLFSD

SEQ ID NO: 142 - protein, 1192 aa, Homo sapiens
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVDETLFALPAASEPVIRSSAENMDLKEQPGNTISAGQEDFPSVLLETAASLPSLSPLSAASFKEHEYLGNLSTVLPTEGTLQENVSEASKEVSEKAKTLLIDRDLTEFSELEYSEMGSSFSVSPKAESAVIVANPREEIIVKNKDEEEKLVSNNILHNQQELPTALTKLVKEDEVVSSEKAKDSFNEKRVAVEAPMREEYADFKPFERVWEVKDSKEDSDMLAAGGKIESNLESKVDKKCFADSLEQTNHEKDSESSNDDTSFPSTPEGIKDRSGAYITCAPFNPAATESIATNIFPLLGDPTSENKTDEKKIEEKKAQIVTEKNTSTKTSNPFLVAAQDSETDYVTTDNLTKVTEEVVANMPEGLTPDLVQEACESELNEVTGTKIAYETKMDLVQTSEVMQESLYPAAQLCPSFEESEATPSPVLPDIVMEAPLNSAVPSAGASVIQPSSSPLEASSVNYESIKHEPENPPPYEEAMSVSLKKVSGIKEEIKEPENINAALQETEAPYISIACDLIKETKLSAEPAPDFSDYSEMAKVEQPVPDHSELVEDSSPDSEPVDLFSDDSIPDVPQKQDETVMLVKESLTETSFESMIEYENKEKLSALPPEGGKPYLESFKLSLDNTKDTLLPDEVSTLSKKEKIPLQMEELSTAVYSNDDLFISKEAQIRETETFSDSSPIEIIDEFPTLISSKTDSFSKLAREYTDLEVSHKSEIANAPDGAGSLPCTELPHDLSLKNIQPKVEEKISFSDDFSKNGSATSKVLLLPPDVSALATQAEIESIVKPKVLVKEAEKKLPSDTEKEDRSPSAIFSAELSKTSVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 143 - protein, 432 aa, Homo sapiens
MGPAGSLLGSGQMQITLWGSLAAVAIFFVITFLIFLCSSCDREKKPRQHSGDHENLMNVPSDKEMFSRSVTSLATDAPASSEQNGALTNGDILSEDSTLTCMQHYEEVQTSASDLLDSQDSTGKPKCHQSRELPRIPPESAVDTMLTARSVDGDQGLGMEGPYEVLKDSSSQENMVEDCLYETVKEIKEVAAAAHLEKGHSGKAKSTSASKELPGPQTEGKAEFAEYASVDRNKKCRQSVNVESILGNSCDPEEEAPPPVPVKLLDENENLQEKEGGEAEESATDTTSETNKRFSSLSYKSREEDPTLTEEEISAMYSSVNKPGQLVNKSGQSLTVPESTYTSIQGDPQRSPSSCNDLYATVKDFEKTPNSTLPPAGRPSEEPEPDYEAIQTLNREEEKATLGTNGHHGLVPKENDYESISDLQQGRDITRL

SEQ ID NO: 144 - protein, 1712 aa, Homo sapiens
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAVQPGTVGPQGRRGPPGAPGEMGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 145 - protein, 299 aa, Homo sapiens
MDLLWILPSLWLLLLGGPACLKTQEHPSCPGPRELEASKVVLLPSCPGAPGSPGEKGAPGPQGPPGPPGKMGPKGEPGDPVNLLRCQEGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 146 - protein, 1025 aa, Homo sapiens
MAGTYSSTLKTLEDLTLDSGYGAGDSCRSLSLSSSKSNSQALNSSAQQHRGAAWWCYSGSMNSRHNSWDTVNTVLPEDPEVADLFSRCPRLPELEEFPWTEGDVARVLRKGAGGRRLPQFSAEAVRRLAGLLRRALIRVAREAQRLSVLHAKCTRFEVQSAVRLVHSWALAESCALAAVKALSLYSMSAGDGLRRGKSARCGLTFSVGRFFRWMVDTRISVRIHEYAAISLTACMENLVEEIRARVMASHSPDGGGAGGGEVSAEALEMVINNDAELWGVLQPYEHLICGKNANGVLSLPAYFSPYNGGSLGHDERADAYAQLELRTLEQSLLATCVGSISELSDLVSRAMHHMQGRHPLCPGASPARQARQPPQPITWSPDALHTLYYFLRCPQMESMENPNLDPPRMTLNNERPFMLLPPLMEWMRVAITYAEHRRSLTVDSGDIRQAARLLLPGLDCEPRQLKPEHCFSSFRRLDARAATEKFNQDLGFRMLNCGRTDLINQAIEALGPDGVNTMDDQGMTPLMYACAAGDEAMVQMLIDAGANLDIQVPSNSPRHPSIHPDSRHWTSLTFAVLHGHISVVQLLLDAGAHVEGSAVNGGEDSYAETPLQLASAAGNYELVSLLLSRGADPLLSMLEAHGMGSSLHEDMNCFSHSAAHGHRNVLRKLLTQPQQAKADVLSLEEILAEGVEESDASSQGSGSEGPVRLSRTRTKALQEAMYYSAEHGYVDITMELRALGVPWKLHIWIESLRTSFSQSRYSVVQSLLRDFSSIREEEYNEELVTEGLQLMFDILKTSKNDSVIQQLATIFTHCYGSSPIPSIPEIRKTLPARLDPHFLNNKEMSDVTFLVEGKLFYAHKVLLVTASNRFKTLMTNKSEQDGDSSKTIEISDMKYHIFQMMMQYLYYGGTESMEIPTTDILELLSAASLFQLDALQRHCEILCSQTLSMESAVNTYKYAKIHNAPELALFCEGFFLKHMKALLEQDAFRQLIYGRSSKVQGLDPLQDLQNTLAERVHSVYITSRV

SEQ ID NO: 147 - protein, 276 aa, Homo sapiens
MSYGPLDMYRNPGPSGPQLRDFSSIIQTCSGNIQRISQATAQIKNLMSQLGTKQDSSKLQENLQQLQHSTNQLAKETNELLKELGSLPLPLSTSEQRQQRLQKERLMNDFSAALNNFQAVQRRVSEKEKESIARARAGSRLSAEERQREEQLVSFDSHEEWNQMQSQEDEVAITEQDLELIKERETAIRQLEADILDVNQIFKDLAMMIHDQGDLIDSIEANVESSEVHVERATEQLQRAAYYQKKSRKKMCILVLVLSVIILILGLIIWLVYKTK

SEQ ID NO: 148 - protein, 503 aa, Homo sapiens
MTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLALILGPVLALLALVALGVLGLWHVRRRQEKQRGLHSELGESSLILKASEQGDSMLGDLLDSDCTTGSGSGLPFLVQRTVARQVALVECVGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 149 - protein, 1621 aa, Homo sapiens
MEGCMGEESFQMWELNRRLEAYLARVKALEEQNELLSAELGGLRAQSADTSWRAHADDELAALRALVDQRWREKHAAEVARDNLAEELEGVAGRCQQLRLARERTTEEVARNRRAVEAEKCARAWLSSQVAELERELEALRVAHEEERVGLNAQAACAPRCPAPPRGPPAPAPEVEELARRLGEAWRGAVRGYQERVAHMETSLGQARERLGRAVQGAREGRLELQQLQAERGGLLERRAALEQRLEGRWQERLRATEKFQLAVEALEQEKQGLQSQIAQVLEGRQQLAHLKMSLSLEVATYRTLLEAENSRLQTPGGGSKTSLSFQDPKLELQFPRTPEGRRLGSLLPVLSPTSLPSPLPATLETPVPAFLKNQEFLQARTPTLASTPIPPTPQAPSPAVDAEIRAQDAPLSLLQTQGGRKQAPEPLRAEARVAIPASVLPGPEEPGGQRQEASTGQSPEDHASLAPPLSPDHSSLEAKDGESGGSRVFSICRGEGEGQIWGLVEKETAIEGKVVSSLQQEIWEEEDLNRKEIQDSQVPLEKETLKSLGEEIQESLKTLENQSHETLERENQECPRSLEEDLETLKSLEKENKELLKDVEVVRPLEKEAVGQLKPTGKEDTQTLQSLQKENQELMKSLEGNLETFLFPGTENQELVSSLQENLESLTALEKENQEPLRSPEVGDEEALRPLTKENQEPLRSLEDENKEAFRSLEKENQEPLKTLEEEDQSIVRPLETENHKSLRSLEEQDQETLRTLEKETQQRRRSLGEQDQMTLRPPEKVDLEPLKSLDQEIARPLENENQEFLKSLKEESVEAVKSLETEILESLKSAGQENLETLKSPETQAPLWTPEEINQGAMNPLEKEIQEPLESVEVNQETFRLLEEENQESLRSLGAWNLENLRSPEEVDKESQRNLEEEENLGKGEYQESLRSLEEEGQELPQSADVQRWEDTVEKDQELAQESPPGMAGVENEDEAELNLREQDGFTGKEEVVEQGELNATEEVWIPGEGHPESPEPKEQRGLVEGASVKGGAEGLQDPEGQSQQVGAPGLQAPQGLPEAIEPLVEDDVAPGGDQASPEVMLGSEPAMGESAAGAEPGPGQGVGGLGDPGHLTREEVMEPPLEEESLEAKRVQGLEGPRKDLEEAGGLGTEFSELPGKSRDPWEPPREGREESEAEAPRGAEEAFPAETLGHTGSDAPSPWPLGSEEAEEDVPPVLVSPSPTYTPILEDAPGPQPQAEGSQEASWGVQGRAEALGKVESEQEELGSGEIPEGPQEEGEESREESEEDELGETLPDSTPLGFYLRSPTSPRWDPTGEQRPPPQGETGKEGWDPAVLASEGLEAPPSEKEEGEEGEEECGRDSDLSEEFEDLGTEAPFLPGVPGEVAEPLGQVPQLLLDPAAWDRDGESDGFADEEESGEEGEEDQEEGREPGAGRWGPGSSVGSLQALSSSQRGEFLESDSVSVSVPWDDSLRGAVAGAPKTALETESQDSAEPSGSEEESDPVSLEREDKVPGPLEIPSGMEDAGPGADIIGVNGQGPNLEGKSQHVNGGVMNGLEQSEEVGQGMPLVSEGDRGSPFQEEEGSALKTSWAGAPVHLGQGQFLKFTQREGDRESWSSGED

SEQ ID NO: 150 - protein, 1894 aa, Homo sapiens
MEQRRPWPRALEVDSRSVVLLSVVWVLLAPPAAGMPQFSTFHSENRDWTFNHLTVHQGTGAVYVGAINRVYKLTGNLTIQVAHKTGPEEDNKSCYPPLIVQPCSEVLTLTNNVNKLLIIDYSENRLLACGSLYQGVCKLLRLDDLFILVEPSHKKEHYLSSVNKTGTMYGVIVRSEGEDGKLFIGTAVDGKQDYFPTLSSRKLPRDPESSAMLDYELHSDFVSSLIKIPSDTLALVSHFDIFYIYGFASGGFVYFLTVQPETPEGVAINSAGDLFYTSRIVRLCKDDPKFHSYVSLPFGCTRAGVEYRLLQAAYLAKPGDSLAQAFNITSQDDVLFAIFSKGQKQYHHPPDDSALCAFPIRAINLQIKERLQSCYQGEGNLELNWLLGKDVQCTKAPVPIDDNFCGLDINQPLGGSTPVEGLTLYTTSRDRMTSVASYVYNGYSVVFVGTKSGKLKKIRADGPPHGGVQYEMVSVLKDGSPILRDMAFSIDQRYLYVMSERQVTRVPVESCEQYTTCGECLSSGDPHCGWCALHNMCSRRDKCQQAWEPNRFAASISQCVSLAVHPSSISVSEHSRLLSLVVSDAPDLSAGIACAFGNLTEVEGQVSGSQVICISPGPKDVPVIPLDQDWFGLELQLRSKETGKIFVSTEFKFYNCSAHQLCLSCVNSAFRCHWCKYRNLCTHDPTTCSFQEGRINISEDCPQLVPTEEILIPVGEVKPITLKARNLPQPQSGQRGYECVLNIQGAIHRVPALRFNSSSVQCQNSSYQYDGMDISNLAVDFAVVWNGNFIIDNPQDLKVHLYKCAAQRESCGLCLKADRKFECGWCSGERRCTLHQHCTSPSSPWLDWSSHNVKCSNPQITEILTVSGPPEGGTRVTIHGVNLGLDFSEIAHHVQVAGVPCTPLPGEYIIAEQIVCEMGHALVGTTSGPVRLCIGECKPEFMTKSHQQYTFVNPSVLSLNPIRGPESGGTMVTITGHYLGAGSSVAVYLGNQTCEFYGRSMSEIVCVSPPSSNGLGPVPVSVSVDRAHVDSNLQFEYIDDPRVQRIEPEWSIASGHTPLTITGFNLDVIQEPRIRVKFNGKESVNVCKVVNTTTLTCLAPSLTTDYRPGLDTVERPDEFGFVFNNVQSLLIYNDTKFIYYPNPTFELLSPTGVLDQKPGSPIILKGKNLCPPASGGAKLNYTVLIGETPCAVTVSETQLLCEPPNLTGQHKVMVHVGGMVFSPGSVSVISDSLLTLPAIVSIAAGGSLLLIIVIIVLIAYKRKSRENDLTLKRLQMQMDNLESRVALECKEAFAELQTDINELTSDLDRSGIPYLDYRTYAMRVLFPGIEDHPVLRELEVQGNGQQHVEKALKLFAQLINNKVFLLTFIRTLELQRSFSMRDRGNVASLIMTGLQGRLEYATDVLKQLLSDLIDKNLENKNHPKLLLRRTESVAEKMLTNWFAFLLHKFLKECAGEPLFMLYCAIKQQMEKGPIDAITGEARYSLSEDKLIRQQIEYKTLILNCVNPDNENSPEIPVKVLNCDTITQVKEKILDAVYKNVPYSQRPRAVDMDLEWRQGRIARVVLQDEDITTKIEGDWKRLNTLMHYQVSDRSVVALVPKQTSSYNIPASASISRTSISRYDSSFRYTGSPDSLRSRAPMITPDLESGVKVWHLVKNHDHGDQKEGDRGSKMVSEIYLTRLLATKGTLQKFVDDLFETLFSTVHRGSALPLAIKYMFDFLDEQADRHSIHDTDVRHTWKSNCLPLRFWVNVIKNPQFVFDIHKGSITDACLSVVAQTFMDSCSTSEHRLGKDSPSNKLLYAKDIPSYKSWVERYYADIAKLPAISDQDMNAYLAEQSRLHAVEFNMLSALNEIYSYVSKYSEELIGALEQDEQARRQRLAYKVEQLINAMSIES

SEQ ID NO: 151 - protein, 558 aa, Homo sapiens
MRCALALSALLLLLSTPPLLPSSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLLETVFHHVSQAGLELLTSGDLPTLASQSAGITASSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 152 - protein, 738 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPDAVESRYSRTEGSLDGT

SEQ ID NO: 153 - protein, 610 aa, Homo sapiens
MTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 154 - protein, 137 aa, Homo sapiens
MKPPAAQGSPAAAAAAAPALDSAAAEDLSDALCEFDAVLADFASPFHERHFHYEEHLERMKRRSSASVSDSSGFSDSESADSLYRNSFSFSDEKLNSPTDSTPALLSATVTPQKAKLGDTKELEAFIADLDKTLASM

SEQ ID NO: 155 - protein, 93 aa, Homo sapiens
MLTELEKALNSIIDVYHKYSLIKGNFHAVYRDDLKKLLETECPQYIRKKGADVWFKELDINTDGAVNFQEFLILVIKMGVAAHKKSHEESHKE

SEQ ID NO: 156 - protein, 658 aa, Homo sapiens
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTRSPSKREPVVAVAAPASSESSSTNHSIGSTQSTPCSTSSMA

SEQ ID NO: 157 - protein, 377 aa, Homo sapiens
MRLSVRRVLLAAGCALVLVLAVQLGQQVLECRAVLAGLRSPRGAMRPEQEELVMVGTNHVEYRYGKAMPLIFVGGVPRSGTTLMRAMLDAHPEVRCGEETRIIPRVLAMRQAWSKSGREKLRLDEAGVTDEVLDAAMQAFILEVIAKHGEPARVLCNKDPFTLKSSVYLSRLFPNSKFLLMVRDGRASVHSMITRKVTIAGFDLSSYRDCLTKWNKAIEVMYAQCMEVGKEKCLPVYYEQLVLHPRRSLKLILDFLGIAWSDAVLHHEDLIGKPGGVSLSKIERSTDQVIKPVNLEALSKWTGHIPGDVVRDMAQIAPMLAQLGYDPYANPPNYGNPDPFVINNTQRVLKGDYKTPANLKGYFQVNQNSTSSHLGSS

SEQ ID NO: 158 - protein, 469 aa, Homo sapiens
MSIHFSSPVFTSRSAAFSGRGAQVRLSSARPGGLGSSSLYGLGASRPRVAVRSAYGGPVGAGIREVTINQSLLAPLRLDADPSLQRVRQEESEQIKTLNNKFASFIDKVRFLEQQNKLLETKWTLLQEQKSAKSSRLPDIFEAQIAGLRGQLEALQVDGGRLEAELRSMQDVVEDFKNKYEDEINHRTAAENEFVVLKKDVDAAYMSKVELEAKVDALNDEINFLRTLNETELTELQSQISDTSVVLSMDNSRSLDLDGIIAEVKAQYEEMAKCSRAEAEAWYQTKFETLQAQAGKHGDDLRNTRNEISEMNRAIQRLQAEIDNIKNQRAKLEAAIAEAEERGELALKDARAKQEELEAALQRGKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 159 - protein, 812 aa, Homo sapiens [sequence omitted]

SEQ ID NO: 160 - protein, 1960 aa, Homo sapiens
MAQQAADKYLYVDKNFINNPLAQADWAAKKLVWVPSDKSGFEPASLKEEVGEEAIVELVENGKKVKVNKDDIQKMNPPKFSKVEDMAELTCLNEASVLHNLKERYYSGLIYTYSGLFCVVINPYKNLPIYSEEIVEMYKGKKRHEMPPHIYAITDTAYRSMMQDREDQSILCTGESGAGKTENTKKVIQYLAYVASSHKSKKDQGELERQLLQANPILEAFGNAKTVKNDNSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 161 - protein, 466 aa, Homo sapiens
MAFVLILVLSFYELVSGQWQVTGPGKFVQALVGEDAVFSCSLFPETSAEAMEVRFFRNQFHAVVHLYRDGEDWESKQMPQYRGRTEFVKDSIAGGRVSLRLKNITPSDIGLYGCWFSSQIYDEEATWELRVAALGSLPLISIVGYVDGGIQLLCLSSGWFPQPTAKWKGPQGQDLSSDSRANADGYSLYDVEISIIVQENAGSILCSIHLAEQSHEVESKVLIGETFFQPSPWRLASILLGLLCGALCGVVMGMIIVFFKSKGKIQAELDWRRKHGQAELRDARKHAVEVTLDPETAHPKLCVSDLKTVTHRKAPQEVPHSEKRFTRKSVVASQGFQAGKHYWEVDVGQNVGWYVGVCRDDVDRGKNNVTLSPNNGYWVLRLTTEHLYFTFNPHFISLPPSTPPTRVGVFLDYEGGTISFFNTNDQSLIYTLLTCQFEGLLRPYIQHAMYDEEKGTPIFICPVSWG

SEQ ID NO: 162 - protein, 372 aa, Homo sapiens
MLDGLGVVAISIFGIQLKTEGSLRTAVPGIPTQSAFNKCLQRYIGALGARVICDNIPGLVSRQRQLCQRYPDIMRSVGEGAREWIRECQHQFRHHRWNCTTLDRDHTVFGRVMLRSSREAAFVYAISSAGVVHAITRACSQGELSVCSCDPYTRGRHHDQRGDFDWGGCSDNIHYGVRFAKAFVDAKEKRLKDARALMNLHNNRCGRTAVRRFLKLECKCHGVSGSCTLRTCWRALSDFRRTGDYLRRRYDGAVQVMATQDGANFTAARQGYRRATRTDLVYFDNSPDYCVLDKAAGSLGTAGRVCSKTSKGTDGCEIMCCGRGYDTTRVTRVTQCECKFHWCCAVRCKECRNTVDVHTCKAPKKAEWLDQT

SEQ ID NO: 163 - protein, 1377 aa, Homo sapiens
MDALNRNQIGPGCQTQTMVQKGPLDLIETGKGLKVQTDKPHLVSLGSGRLSTAITLLPLEEGRTVIGSAARDISLQGPGLAPEHCYIENLRGTLTLYPCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKEAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKEMEKLLLPAVDLEQWYQELMAGLGTGPAAASPHSSPPPLPAKASRQLQVYRSKMDGEATSPLPRTRSGPLPSSSGSSSSSSQLSVATLGRSPSPKSALLTQNGTGSLPRNLAATLQDIETKRQLALQQKGQQVIEEQRRRLAELKQKAAAEAQCQWDALHGAAPFPAGPSGFPPLMHHSILHHLPAGRERGEEGEHAYDTLSLESSDSMETSISTGGNSACSPDNMSSASGLDMGKIEEMEKMLKEAHAEKNRLMESREREMELRRQALEEERRRREQVERRLQSESARRQQLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYDHLRSAAKKRFFRFTMVTESPNPALTFCVKTHDRLYYMVAPSAEAMRIWMDVIVTGAEGYTQFMN

SEQ ID NO: 164 - protein, 505 aa, Homo sapiens
MEPSWLQELMAHPFLLLILLCMSLLLFQVIRLYQRRRWMIRALHLFPAPPAHWFYGHKEFYPVKEFEVYHKLMEKYPCAVPLWVGPFTMFFSVHDPDYAKILLKRQDPKSAVSHKILESWVGRGLVTLDGSKWKKHRQIVKPGFNISILKIFITMMSESVRMMLNKWEEHIAQNSRLELFQHVSLMTLDSIMKCAFSHQGSIQLDSTLDSYLKAVFNLSKISNQRMNNFLHHNDLVFKFSSQGQIFSKFNQELHQFTEKVIQDRKESLKDKLKQDTTQKRRWDFLDILLSAKSENTKDFSEADLQAEVKTFMFAGHDTTSSAISWILYCLAKYPEHQQRCRDEIRELLGDGSSITWEHLSQMPYTTMCIKECLRLYAPVVNISRLLDKPITFPDGRSLPAGITVFINIWALHHNPYFWEDPQVFNPLRFSRENSEKIHPYAFIPFSAGLRNCIGQHFAIIECKVAVALTLLRFKLAPDHSRPPQPVRQVVLKSKNGIHVFAKKVC

SEQ ID NO: 165 - protein, 496 aa, Homo sapiens
MFRSKRSGLVRRLWRSRVVPDREEGGSGGGGGGDEDGSLGSRAEPAPRAREGGGCGRSEVRPVAPRRPRDAVGQRGAQGAGRRRRAGGPPRPMSEPGAGAGSSLLDVAEPGGPGWLPESDCETVTCCLFSERDAAGAPRDASDPLAGAALEPAGGGRSREARSRLLLLEQELKTVTYSLLKRLKERSLDTLLEAVESRGGVPGGCVLVPRADLRLGGQPAPPQLLLGRLFRWPDLQHAVELKPLCGCHSFAAAADGPTVCCNPYHFSRLCGPESPPPPYSRLSPRDEYKPLDLSDSTLSYTETEATNSLITAPGEFSDASMSPDATKPSHWCSVAYWEHRTRVGRLYAVYDQAVSIFYDLPQGSGFCLGQLNLEQRSESVRRTRSKIGFGILLSKEPDGVWAYNRGEHPIFVNSPTLDAPGGRALVVRKVPPGYSIKVFDFERSGLQHAPEPDAADGPYDPNSVRISFAKGWGPCYSRQFITSCPCWLEILLNNPR

SEQ ID NO: 166 - protein, 737 aa, Homo sapiens
MVVFNGLLKIKICEAVSLKPTAWSLRHAVGPRPQTFLLDPYIALNVDDSRIGQTATKQKTNSPAWHDEFVTDVCNGRKIELAVFHDAPIGYDDFVANCTIQFEELLQNGSRHFEDWIDLEPEGRVYVIIDLSGSSGEAPKDNEERVFRERMRPRKRQGAVRRRVHQVNGHKFMATYLRQPTYCSHCRDFIWGVIGKQGYQCQVCTCVVHKRCHELIITKCAGLKKQETPDQVGSQRFSVNMPHKFGIHNYKVPTFCDHCGSLLWGLLRQGLQCKVCKMNVHRRCETNVAPNCGVDARGIAKVLADLGVTPDKITNSGQRRKKLIAGAESPQPASGSSPSEEDRSKSAPTSPCDQEIKELENNIRKALSFDNRGEEHRAASSPDGQLMSPGENGEVRQGQAKRLGLDEFNFIKVLGKGSFGKVMLAELKGKDEVYAVKVLKKDVILQDDDVDCTMTEKRILALARKHPYLTQLYCCFQTKDRLFFVMEYVNGGDLMFQIQRSRKFDEPRSRFYAAEVTSALMFLHQHGVIYRDLKLDNILLDAEGHCKLADFGMCKEGILNGVTTTTFCGTPDYIAPEILQELEYGPSVDWWALGVLMYEMMAGQPPFEADNEDDLFESILHDDVLYPVWLSKEAVSILKAFMTKNPHKRLGCVASQNGEDAIKQHPFFKEIDWVLLEQKKIKPPFKPRIKTKRDVNNFDQDFTREEPVLTLVDEAIVKQINQEEFKGFSYFGEDLMP

SEQ ID NO: 167 - protein, 485 aa, Homo sapiens
MPAMVEKGPEVSGKRRGRNNAAASASAAAASAAASAACASPAATAASGAAASSASAAAASAAAAPNNGQNKSLAAAAPNGNSSSNSWEEGSSGSSSDEEHGGGGMRVGPQYQAVVPDFDPAKLARRSQERDNLGMLVWSPNQNLSEAKLDEYIAIAKEKHGYNMEQALGMLFWHKHNIEKSLADLPNFTPFPDEWTVEDKVLFEQAFSFHGKTFHRIQQMLPDKSIASLVKFYYSWKKTRTKTSVMDRHARKQKREREESEDELEEANGNNPIDIEVDQNKESKKEVPPTETVPQVKKEKHSTQAKNRAKRKPPKGMFLSQEDVEAVSANATAATTVLRQLDMELVSVKRQIQNIKQTNSALKEKLDGGIEPYRLPEVIQKCNARWTTEEQLLAVQAIRKYGRDFQAISDVIGNKSVVQVKNFFVNYRRRFNIDEVLQEWEAEHGKEETNGPSNQKPVKSPDNSIKMPEEEDEAPVLDVRYASAS

SEQ ID NO: 168 - protein, 1076 aa, Homo sapiens
MAEFTSYKETASSRHLRFKLQSLSRRLDELEEATKNLQKAEDELLDLQDKVIQAEGSNSSMLAEIEVLRQRVLRIEGKDEEIKRAEDLCRLMKEKLEEEENLTRELKSEIERLQKRMAELEKLEEAFSRSKNDCTQLCLSLNEERNLTKKISSELEMLRVKVKELESSEDRLDKTEQSLASELEKLKSLTLSFVSERKYLNEKEKENEKLIKELTQKLEQNKKMNRDYTRNASNLERNDLRIEDGISSTLPSKESRRKGGLDYLKQVENETRNKSENEKNRNQEDNKVKDLNQEIEKLKTQIKHFESLEEELKKMKSKNNDLQDNYLSEQNKNKLLASQLEEIKLQIKKQKELENGEVEGEDAFLSSKGRHERTKFRGHGSEASVSKHTARELSPQHKRERLRNREFALNNENYSLSNRQVSSPSFTNRRAAKASHMGVSTDSGTQETKKTEDRFVPGSSQSEGKKSREQPSVLSRYPPAAQEHSKAWKGTSKPGTESGLKGKVEKTTRTFSDTTHGSVPSDPLGRADKASDTSSETVFGKRGHVLGNGSQVTQAANSGCSKAIGALASSRRSSSEGLSKGKKAANGLEADNSCPNSKAPVLSKYPYSCRSQENILQGFSTSHKEGVNQPAAVVMEDSSPHEALRCRVIKSSGREKPDSDDDLDIASLVTAKLVNTTITPEPEPKPQPNSREKAKTRGAPRTSLFENDKDAGMENESVKSVRASTNTMELPDTNGAGVKSQRPFSPREALRSRAIIKPVIVDKDVKKIMGGSGTETTLEKQKPVSKPGPNKVTSSITIYPSDSSSPRAAPGEALRERHTSTSNIQVGLAELTSVSNHVSSPFELSIHKHDITLQLAEAERMADGPLKDRPETVVSRSSIIIKPSDPVERNSHAPPAETIRWKSHSAPSEVGFSDARHVTVRNAWKSRRDLKSLEDPPTRIGKNVESTNSNAYTQRSSTDFSELEQPRSCLFEQGTRRVGPSSGDAPEPSSRRTQSSLTVSEVLTRRNRVGDTITVAAWNHSASMEEEGEDCTLSVYRQLHNSLDPSELPGKQGLPESGRVRAEERLRPTRPCAEEN

SEQ ID NO: 169 - protein, 1050 aa, Homo sapiens
MLCWGYWSLGQPGISTNLQGIVAEPQVCGFISDRSVKEVACGGNHSVFLLEDGEVYTCGLNTKGQLGHEREGNKPEQIGALADQHIIHVACGESHSLALSDRGQLFSWGAGSDGQLGLMTTEDSVAVPRLIQKLNQQTILQVSCGNWHCLALAADGQFFTWGKNSHGQLGLGKEFPSQASPQRVRSLEGIPLAQVAAGGAHSFALSLSGAVFGWGMNNAGQLGLSDEKDRESPCHVKLLRTQKVVYISCGEEHTAVLTKSGGVFTFGAGSCGQLGHDSMNDEVNPRRVLELMGSEVTQIACGRQHTLAFVPSSGLIYAFGCGARGQLGTGHTCNVKCPSPVKGYWAAHSGQLSARADRFKYHIVKQIFSGGDQTFVLCSKYENYSPAVDFRTMNQAHYTSLINDETIAVWRQKLSEHNNANTINGVVQILSSAACWNGSFLEKKIDEHFKTSPKIPGIDLNSTRVLFEKLMNSQHSMILEQILNSFESCLIPQLSSSPPDVEAMRIYLILPEFPLLQDSKYYITLTIPLAMAILRLDTNPSKVLDNWWSQVCPKYFMKLVNLYKGAVLYLLRGRKTFLIPVLFNNYITAALKLLEKLYKVNLKVKHVEYDTFYIPEISNLVDIQEDYLMWFLHQAGMKARPSIIQDTVTLCSYPFIFDAQAKTKMLQTDAELQMQVAVNGANLQNVFMLLTLEPLLARSPFLVLHVRRNNLVGDALRELSIHSDIDLKKPLKVIFDGEEAVDAGGVTKEFFLLLLKELLNPIYGMFTYYQDSNLLWFSDTCFVEHNWFHLIGITCGLAIYNSTVVDLHFPLALYKKLLNVKPGLEDLKELSPTEGRSLQELLDYPGEDVEETFCLNFTICRESYGVIEQKKLIPGGDNVTVCKDNRQEFVDAYVNYVFQISVHEWYTAFSSGFLKVCGGKVLELFQPSELRAMMVGNSNYNWEELEETAIYKGDYSATHPTVKLFWETFHEFPLEKKKKFLLFLTGSDRIPIYGMASLQIVIQSTASGEEYLPVAHTCYNLLDLPKYSSKEILSARLTQALDNYEGFSLA

SEQ ID NO: 170 - protein, 1423 aa, Homo sapiens
MYFLSGWPKRLLCPLGSPAEAPFHVQSDPQRAFFAVLAAARLSIWYSRPSVLIVTYKEPAKSSTQFGSYKQAEWRPDSTMIAVSTANGYILFFHITSTRGDKYLYEPVYPKGSPQMKGTPHFKEEQCAPALNLEMRKILDLQAPIMSLQSVLEDLLVATSDGLLHLIHWEGMTNGRKAINLCTVPFSVDLQSSRVGSFLGFTDVHIRDMEYCATLDGFAVVFNDGKVGFITPVSSRFTAEQLHGVWPQDVVDGTCVAVNNKYRLMAFGCVSGSVQVYTIDNSTGAMLLSHKLELTAKQYPDIWNKTGAVKLMRWSPDNSVVIVTWEYGGLSLWSVFGAQLICTLGGDFAYRSDGTKKDPLKINSMSWGAEGYHLWVISGFGSQNTEIESDLRSVVKQPSILLFQFIKSVLTVNPCMSNQEQVLLQGEDRLYLNCGEASQTQNPRSSSTHSEHKPSREKSPFADGGLESQGLSTLLGHRHWHVVQISSTYLESNWPIRFSAIDKLGQNIAVVGKFGFAHYSLLTKKWKLFGNITQEQNMIVTGGLAWWNDFMVLACYNINDRQEELRVYLRTSNLDNAFAHVTKAQAETLLLSVFQDMVIVFRADCSICLYSIERKSDGPNTTAGIQVLQEVSMSRYIPHPFLVVSVTLTSVSTENGITLKMPQQARGAESIMLNLAGQLIMMQRDRSGPQIREKDSNPNNQRKLLPFCPPVVLAQSVENVWTTCRANKQKRHLLEALWLSCGGAGMKVWLPLFPRDHRKPHSFLSQRIMLPFHINIYPLAVLFEDALVLGAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQNMEVPAVSRQHATLLFNTALEQGKWDLCRHMIRFLKAIGSGESETPPSTPTAQEPSSSGGFEFFRNRSISLSQSAENVPASKFSLQKTLSMPSGPSGKRWSKDSDCAENMYIDMMLWRHARRLLEDVRLKDLGCFAAQLGFELISWLCKERTRAARVDNFVIALKRLHKDFLWPLPIIPASSISSPFKNGKYRTVGEQLLKSQSADPFLNLEMDAGISNIQRSQSWLSNIGPTHHEIDTASSHGPQMQDAFLSPLSNKGDECSIGSATDLTESSSMVDGDWTMVDENFSTLSLTQSELEHISMELASKGPHKSQVQLRYLLHIFMEAGCLDWCIVIGLILRESSIINQILVITQSSEVDGEMLQNIKTGLHAVDRWASTDCPGYKPFLNIIKPQLQKLSEITEEQVQPDAFQPITMGKTPEQTSPRAEESRGSSSHGSIPQGEVGSSNMVSRKEEDTAQAEEEEPFQDGTYDCSVS

SEQ ID NO: 171 - protein, 508 aa, Homo sapiens
MRCPKSAVTMRNEELLLSNGTANKMNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 172 - protein, 686 aa, Homo sapiens
MADRRRAWNTEDDLPVYLARPGSAAQTPRQKYGGMFAAVEGAYENKTIDFDAYSVGRRGSARTPRSAGRPDAVGLPGPGGSEDTASDVSEPSGSAVSSPGERDERPPTLRIRRPAPRDLPLGRDNGQSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 173 - protein, 382 aa, Homo sapiens
MGPTSVPLVKAHRSSVSDYVNYDIIVRHYNYTGKLNISADKENSIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNNFRLFLLISACWVISLILGGLPIMGWNCISALSSCSTVLPLYHKHYILFCTTVFTLLLLSIVILYCRIYSLVRTRSRRLTFRKNISKASRSSEKSLALLKTVIIVLSVFIACWAPLFILLLLDVGCKVKTCDILFRAEYFLVLAVLNSGTNPIIYTLTNKEMRRAFIRIMSCCKCPSGDSAGKFKRPIIAGMEFSRSKSDNSSHPQKDEGDNPETIMSSGNVNSSS

SEQ ID NO: 174 - protein, 117 aa, Homo sapiens
MKFQYKEDHPFEYRKKEGEKIRKKYPDRVPVIVEKAPKARVPDLDKRKYLVPSDLTVGQFYFLIRKRIHLRPEDALFFFVNNTIPPTSATMGQLYEDNHEEDYFLYVAYSDESVYGK

SEQ ID NO: 175 - protein, 193 aa, Homo sapiens
MGKQNSKLRPEVLQDLRENTEFTDHELQEWYKGFLKDCPTGHLTVDEFKKIYANFFPYGDASKFAEHVFRTFDTNGDGTIDFREFIIALSVTSRGKLEQKLKWAFSMYDLDGNGYISRSEMLEIVQAIYKMVSSVMKMPEDESTPEKRTDKIFRQMDTNNDGKLSLEEFIRGAKSDPSIVRLLQCDPSSASQF

SEQ ID NO: 176 - protein, 2322 aa, Homo sapiens
MQSGPRPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGARHGELELDIPGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHRGGPAQDLTFRVSDGLQASPPATLKVVAIRPAIQIHRSTGLRLAQGSAMPILPANLSVETNAVGQDVSVLFRVTGALQFGELQKQGAGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPRDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGALQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 177 - protein, 761 aa, Homo sapiens
MNWRFVELLYFLFIWGRISVQPSHQEPAGTDQHVSKEFDWLISDRGPFHHSRSYLSFVERHRQGFTTRYKIYREFARWKVRNTAIERRDLVRHPVPLMPEFQRSIRLLGRRPTTQQFIDTIIKKYGTHLLISATLGGEEALTMYMDKSRLDRKSGNATQSVEALHQLASSYFVDRDGTMRRLHEIQISTGAIKVTETRTGPLGCNSYDNLDSVSSVLLQSTESKLHLQGLQIIFPQYLQEKFVQSALSYIMCNGEGEYLCQNSQCRCQCAEEFPQCNCPITDIQIMEYTLANMAKSWAEAYKDLENSDEFKSFMKRLPSNHFLTIGSIHQHWGNDWDLQNRYKLLQSATEAQRQKIQRTARKLFGLSVRCRHNPNHQLPRERTIQQWLARVQSLLYCNENGFWGTFLESQRSCVCHGSTTLCQRPIPCVIGGNNSCAMCSLANISLCGSCNKGYKLYRGRCEPQNVDSERSEQFISFETDLDFQDLELKYLLQKMDSRLYVHTTFISNEIRLDTFFDPRWRKRMSLTLKSNKNRMDFIHMVIGMSMRICQMRNSSLDPMFFVYVNPFSGSHSEGWNMPFGEFGYPRWEKIRLQNSQCYNWTLLLGNRWKTFFETVHIYLRSRTRLPTLLRNETGQGPVDLSDPSKRQFYIKISDVQVFGYSLRFNADLLRSAVQQVNQSYTQGGQFYSSSSVMLLLLDIRDRINRLAPPVAPGKPQLDLFSCMLKHRLKLTNSEIIRVNHALDLYNTEILKQSDQMTAKLC

SEQ ID NO: 178 - protein, 530 aa, Homo sapiens
MDDLQSQNLSMDMTDSPPALANNRLENGMAQLITTEAWNINSTDLVKKALVTVPAPSILNPPAESQSGMALKVAATVLQPLCLGESPVVMPIHMQVEGSSAPELNPNGNATYVMTTQGPVQLPVVLEQHVFQHLNSPLVLPQEAPCSSSTIHNNLFQGAEDPEAQPQLLDLRIPSQPQEPTLPFEAVLQNLFPSQGTLGPPPCQPPPGYAPVPPQPFSSPLSPLVPPATLLVPYPVIVPLPVPVPIPIPIPVPQSSESKFSSSFPKPPSSFGLHPFKGTQTPLEKDELKPFDILQPKEYFQLSRHTVIKMGSENEALDLSMKSVPWLKAGEVSPPIFQEDAALDLSVAAHRKSEPPPETLYDSGASVDSSGHTVMEKLPSGMEISFAPATSHEAPAMMDSHISSSDAATEMLSQPNHPSGEVKAENNIEMVGESQAAKVIVSVEDAVPTIFCGKIKGLSGVSTKNFSFKREDSVLQGYDINSQGEESMGNAEPLRKPIKNRSIKLKKVNSQEIHMLPIKKQRLATFFPRK

SEQ ID NO: 179 - protein, 1012 aa, Homo sapiens
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSLLAFIAFLFFASIISLSLIFYYSKKGRRSYK

SEQ ID NO: 180 - protein, 210 aa, Homo sapiens
MSAKSAISKEIFAPLDERMLGAVQVKRRTKKKIPFLATGGQGEYLTYICLSVTNKKPTQASITKVKQFEGSTSFVRRSQWMLEQLRQVNGIDPNGDSAEFDLLFENAFDQWVASTASEKCTFFQILHHTCQRYLTDRKPEFINCQSKIMGGNSILHSAADSVTSAVQKASQALNERGERLGRAEEKTEDLKNSAQQFAETAHKLAMKHKC

SEQ ID NO: 181 - protein, 1669 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMTGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 182 - protein, 331 aa, Homo sapiens
MTERPPSEAARSDPQLEGRDAAEASMAPPHLVLLNGVAKETSRAAAAEPPVIELGARGGPGGGPAGGGGAARDLKGRDAATAEARHRVPTTELCRPPGPAPAPAPASVTAELPGDGRMVQLSPPALAAPAAPGRALLYSLSQPLASLGSGFFGEPDAFPMFTTNNRVKRRPSPYEMEITDGPHTKVVRRIFTNSRERWRQQNVNGAFAELRKLIPTHPPDKKLSKNEILRLAMKYINFLAKLLNDQEEEGTQRAKTGKDPVVGAGGGGGGGGGGAPPDDLLQDVLSPNSSCGSSLDGAASPDSYTEEPAPKHTARSLHPAMLPAADGAGPR

SEQ ID NO: 183 - protein, 341 aa, Homo sapiens
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRAATGN

SEQ ID NO: 184 - protein, 1344 aa, Homo sapiens
MDQREPLPPAPAENEMKYDTNNNEEEEGEQFDFDSGDEIPEADRQAPSAPETGGAGASEAPAPTGGEDGAGAETTPVAEPTKLVLPMKVNPYSVIDITPFQEDQPPTPVPSAEEENVGLHVPCGYLVPVPCGYAVPSNLPLLLPAYSSPVIICATSLDEEETPEVTEDRQPNSLSSEEPPTSEDQVGREDSALARWAADPANTAWMENPEEAIYDDVPRENSDSEPDEMIYDDVENGDEGGNSSLEYGWSSSEFESYEEQSDSECKNGIPRSFLRSNHKKQLSHDLTRLKEHYEKKMRDLMASTVGVVEIQQLRQKHELKMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIECAAYNPEPYLNNESQPDSFSTAHGFLWIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 185 - protein, 173 aa, Homo sapiens
MEEPQRARSHTVTTTASSFAENFSTSSSSFAYDREFLRTLPGFLIVAEIVLGLLVWTLIAGTEYFRVPAFGWVMFVAVFYWVLTVFFLIIYITMTYTRIPQVPWTTVGLCFNGSAFVLYLSAAVVDASSVSPERDSHNFNSWAASSFFAFLVTICYAGNTYFSFIAWRSRTIQ

SEQ ID NO: 186 - protein, 379 aa, Homo sapiens
MSSAPEKQQPPHGGGGGGGGGGGAAMDPASSGPSKAKKTNAGIRRPEKPPYSYIALIVMAIQSSPTKRLTLSEIYQFLQSRFPFFRGSYQGWKNSVRHNLSLNECFIKLPKGLGRPGKGHYWTIDPASEFMFEEGSFRRRPRGFRRKCQALKPMYSMMNGLGFNHLPDTYGFQGSAGGLSCPPNSLALEGGLGMMNGHLPGNVDGMALPSHSVPHLPSNGGHSYMGGCGGAAAGEYPHHDSSVPASPLLPTGAGGVMEPHAVYSGSAAAWPPSASAALNSGASYIKQQPLSPCNPAANPLSGSLSTHSLEQPYLHQNSHNAPAELQGIPRYHSQSPSMCDRKEFVFSFNAMASSSMHSAGGGSYYHQQVTYQDIKPCVM

SEQ ID NO: 187 - protein, 699 aa, Homo sapiens
MGHHRPWLHASVLWAGVASLLLPPAMTQQLRGDGLGFRNRNNSTGVAGLSEEASAELRHHLHSPRDHPDENKDVSTENGHHFWSHPDREKEDEDVSKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSLCGYCSFCNRCTECESCHCDEENMGEHCDQCQHCQFCYLCPLVCETVCAPGSYVDYFSSSLYQALADMLETPEP

SEQ ID NO: 188 - protein, 559 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEAAGGESALAPSVFKQAKDKVSNSTLSKIPALQGSTKSPRYSSACPSTTKRATFSDSLLIQPTSAGSTDRLPYSKSGNKDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVRILNKKIDFSKVQSRCGSKDNIKHSAGGGNVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 189 - protein, 298 aa, Homo sapiens
MLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQSSTSPEGQALENRMKQLSLQCSKGRDGIIADIKMVQIG

SEQ ID NO: 190 - protein, 321 aa, Homo sapiens
MKHIPVLEDGPWKTVCVKELNGLKKLKRKGKEPARRANGYKTFRLDLEAPEPRAVATNGLRDRTHRLQPVPVPVPVPVPVAPAVPPRGGTDTAGERGGSRAPEVSDARKRCFALGAVGPGLPTPPPPPPPAPQSQAPGGPEAQPFREPGLRPRILLCAPPARPAPSAPPAPPAPPESTVRPAPPTRPGESSYSSISHVIYNNHQDSSASPRKRPGEATAASSEIKALQQTRRLLANARERTRVHTISAAFEALRKQVPCYSYGQKLSKLAILRIACNYILSLARLADLDYSADHSNLSFSECVQRCTRTLQAEGRAKKRKE

SEQ ID NO: 191 - protein, 451 aa, Homo sapiens
MAEAAALVWIRGPGFGCKAVRCASGRCTVRDFIHRHCQDQNVPVENFFVKCNGALINTSDTVQHGAVYSLEPRLCGGKGGFGSMLRALGAQIEKTTNREACRDLSGRRLRDVNHEKAMAEWVKQQAEREAEKEQKRLERLQRKLVEPKHCFTSPDYQQQCHEMAERLEDSVLKGMQAASSKMVSAEISENRKRQWPTKSQTDRGASAGKRRCFWLGMEGLETAEGSNSESSDDDSEEAPSTSGMGFHAPKIGSNGVEMAAKFPSGSQRARVVNTDHGSPEQLQIPVTDSGRHILEDSCAELGESKEHMESRMVTETEETQEKKAESKEPIEEEPTGAGLNKDKETEERTDGERVAEVAPEERENVAVAKLQESQPGNAVIDKETIDLLAFTSVAELELLGLEKLKCELMALGLKCGGTLQERAARLFSVRGLAKEQIDPALFAKPLKGKKK

SEQ ID NO: 192 - protein, 639 aa, Homo sapiens
MNLEKLSKPELLTLFSILEGELEARDLVIEALKAQHRDTFIEERYGKYNISDPLMALQRDFETLKEKNDGEKQPVCTNPLSILKVVMKQCKNMQERMLSQLAAAESRHRKVILDLEEERQRHAQDTAEGDDVTYMLEKERERLTQQLEFEKSQVKKFEKEQKKLSSQLEEERSRHKQLSSMLVLECKKATNKAAEEGQKAGELSLKLEKEKSRVSKLEEELAAERKRGLQTEAQVEKQLSEFDIEREQLRAKLNREENRTKTLKEEMESLKKIVKDLEASHQHSSPNEQLKKPVTVSKGTATEPLMLMSVFCQTESFPAERTHGSNIAKMTNTGLPGPATPAYSYAKTNGHCDPEIQTTRELTAGNNVENQVPPREKSVALAQEKPVENGGCPVGIETPVPMPSPLSSSGSSLSPSSTASSSLTSSPCSSPVLTKRLLGSSASSPGYQSSYQVGINQRFHAARHKFQSQADQDQQASGLQSPPSRDLSPTLIDNSAAKQLARNTVTQVLSRFTSQQGPIKPVSPNSSPFGTDYRNLANTANPRGDTSHSPTPGKVSSPLSPLSPGIKSPTIPRAERGNPPPIPPKKPGLTPSPSATTPLTKTHSQAASLTTAEDLASSCSSNTVVANGKDVELLLPTSS

SEQ ID NO: 193 - protein, 1403 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 194 - protein, 416 aa, Homo sapiens
MIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 195 - protein, 948 aa, Homo sapiens
MAEANNPSEQELESEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 196 - protein, 303 aa, Homo sapiens
MAAVAVLRAFGASGPMCLRRGPWAQLPARFCSRDPAGAGRRESEPRPTSARQLDGIRNIVLSNPKKRNTLSLAMLKSLQSDILHDADSNDLKVIIISAEGPVFSSGHDLKELTEEQGRDYHAEVFQTCSKVMMHIRNHPVPVIAMVNGLATAAGCQLVASCDIAVASDKSSFATPGVNVGLFCSTPGVALARAVPRKVALEMLFTGEPISAQEALLHGLLSKVVPEAELQEETMRIARKIASLSRPVVSLGKATFYKQLPQDLGTAYYLTSQAMVDNLALRDGQEGITAFLQKRKPVWSHEPV

SEQ ID NO: 197 - protein, 477 aa, Homo sapiens
MGAGVLVLGASEPGNLSSAAPLPDGAATAARLLVPASPPASLLPPASESPEPLSQQWTAGMGLLMALIVLLIVAGNVLVIVAIAKTPRLQTLTNLFIMSLASADLVMGLLVVPFGATIVVWGRWEYGSFFCELWTSVDVLCVTASIETLCVIALDRYLAITSPFRYQSLLTRARARGLVCTVWAISALVSFLPILMHWWRAESDEARRCYNDPKCCDFVTNRAYAIASSVVSFYVPLCIMAFVYLRVFREAQKQVKKIDSCERRFLGGPARPPSPSPSPVPAPAPPPGPPRPAAAAATAPLANGRAGKRRPSRLVALREQKALKTLGIIMGVFTLCWLPFFLANVVKAFHRELVPDRLFVFFNWLGYANSAFNPIIYCRSPDFRKAFQGLLCCARRAARRRHATHGDRPRASGCLARPGPPPSPGAASDDDDDDVVGATPPARLLEPWAGCNGGAAADSDSSLDEPCRPGFASESKV

SEQ ID NO: 198 - protein, 874 aa, Homo sapiens
MEKLLRLCCWYSWLLLFYYNFQVRGVYSRSQDHPGFQVLASASHYWPLENVDGIHELQDTTGDIVEGKVNKGIYLKEEKGVTLLYYGRYNSSCISKPEQCGPEGVTFSFFWKTQGEQSRPIPSAYGGQVISNGFKVCSSGGRGSVELYTRDNSMTWEASFSPPGPYWTHVLFTWKSKEGLKVYVNGTLSTSDPSGKVSRDYGESNVNLVIGSEQDQAKCYENGAFDEFIIWERALTPDEIAMYFTAAIGKHALLSSTLPSLFMTSTASPVMPTDAYHPIITNLTEERKTFQSPGVILSYLQNVSLSLPSKSLSEQTALNLTKTFLKAVGEILLLPGWIALSEDSAVVLSLIDTIDTVMGHVSSNLHGSTPQVTVEGSSAMAEFSVAKILPKTVNSSHYRFPAHGQSFIQIPHEAFHRHAWSTVVGLLYHSMHYYLNNIWPAHTKIAEAMHHQDCLLFATSHLISLEVSPPPTLSQNLSGSPLITVHLKHRLTRKQHSEATNSSNRVFVYCAFLDFSSGEGVWSNHGCALTRGNLTYSVCRCTHLTNFAILMQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 199 - protein, 1923 aa, Homo sapiens
MGNSYAGQLKSARFEEALHNSIEASLRCSSVVPRPIFSQLYLDPDQHPFSSADVKPKVEDLDKDLVNRYTQNGSLDFSNNLTVNEMEDDEDDEEMSDSNSPPIPYSQKPAPEGSCTTDGFCQAGKDLRLVSLCMEQIDIPAGFLLVGAKSPNLPEHILVCAVDKRFLPDDHGKNALLGFSGNCIGCGERGFRYFTEFSNHINLKLTTQPKKQKHLKYYLVRSSQGVLSKGPLICWKECRSRQSSASCHSIKPSSSVSSTVTPENGTTNGYKSGFTQTDAANGNSSHGGKGSASSSTPAHTGNYSLSPRPSYASGDQATMFISGPPKKRHRGWYPGSPLPQPGLVVPVPTVRPLSRTEPLLSAPVPQTPLTGILQPRPIPAGETVIVPENLLSNSGVRPVILIGYGTLPYFYGNVGDIVVSPLLVNCYKIPQLENKDLEKLGLTGSQFLSVENMILLTIQYLVRLGPDQVPLREEFEQIMLKAMQEFTLRERALQIGAQCVPVSPGQLPWLARLIASVSQDLVHVVVTQNSLAEGISETLRTLSEMRHYQRLPDYVVVICASKIRGNEFCVVVLGQHQSRALAESMLTTSEFLKEISYELITGKVSFLASHFKTTSLGDDLDKLLEKMQQRRGDSVVTPFDGDLNECVSPQEAAAMIPTQNLDLDNETFHIYQPQLTVARKLLSQVCAIADSGSQSLDLGHFSKVDFIIIVPRSEVLVQQTLQRIRQSGVLVDLGLEENGTAHQRAEKYVVRLDNEIQTKFEVFMRRVKQNPYTLFVLVHDNSHVELTSVISGSLSHSEPSHGLADRVINCREVLEAFNLLVLQVSSFPYTLQTQQSRISSSNEVHWIQLDTGEDVGCEEKLYFGLSEYSKSLQWGITSPLLRCDETFEKMVNTLLERYPRLHSMVVRCYLLIQQYSEALMALTTMASLRDHSTPETLSIMDDLISSPGKNKSGRGHMLIIRVPSVQLAMLAKERLQEVRDKLGLQYRFEIILGNPATELSVATHFVARLKSWRGNEPEEWIPRTYQDLDGLPCIVILTGKDPLGETFPRSLKYCDLRLIDSSYLTRTALEQEVGLACCYVSKEVIRGPTVALDLSGKEQERAAVSENDSDELLIDLERPQSNSSAVTGTSGSIMENGVSSSSTADKSQKQSLTPSFQSPATSLGLDEGVSASSAGAGAGETLKQECDSLGPQMASSTTSKPSSSSSGPRTLPWPGQPIRGCRGPQAALPPVVILSKAAYSLLGSQKSGKLPSSSSLLPHADVAWVSSLRPLLNKDMSSEEQSLYYRQWTLARQHHADYSNQLDPASGTRNFHPRRLLLTGPPQVGKTGSYLQFLRILFRMLIRLLEVDVYDEEEINTDHNESSEVSQSEGEPWPDIESFSKMPFDVSVHDPKYSLMSLVYTEKLAGVKQEVIKESKVEEPRKRETVSIMLTKYAAYNTFHHCEQCRQYMDFTSASQMSDSTLHAFTFSSSMLGEEVQLYFIIPKSKESHFVFSKQGKHLESMRLPLVSDKNLNAVKSPIFTPSSGRHEHGLLNLFHAMEGISHLHLLVVKEYEMPLYRKYWPNHIMLVLPGMFNNAGVGAARFLIKELSYHNLELERNRLEELGIKRQCVWPFIVMMDDSCVLWNIHSVQEPSSQPMEVGVSSKNVSLKTVLQHIEATPKIVHYAILGIQKWSSKLTSQSLKAPFSRCHVHDFILLNTDLTQNVQYDFNRYFCEDADFNLRTNSSGLLICRFNNFSLMKKHVQVGGQRDFIIKPKIMVSESLAPILPLQYICAPDSEHTLLAAPAQFLLEKFLQHASYKLFPKAIHNFRSPVLAIDCYLNIGPEVAICYISSRPHSSNVNCEGVFFSGLLLYLCDSFVGADLKKFKFLKGATLCVICQDRSSLRQTIVRLELEDEWQFRLRDEFQTANSSDDKPLYFLTGRHV

SEQ ID NO: 200 - protein, 650 aa, Homo sapiens
MACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMVSSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 201 - protein, 568 aa, Homo sapiens
MRRSVLVRNPGHKGLRPVYEELDSDSEDLDPNPEDLDPVSEDPEPDPEDLNTVPEDVDPSYEDLEPVSEDLDPDAEAPGSEPQDPDPMSSSFDLDPDVIGPVPLILDPNSDTLSPGDPKVDPISSGLTATPQVLATSPAVLPAPASPPRPFSCPDCGRAFRRSSGLSQHRRTHSGEKPYRCPDCGKSFSHGATLAQHRGIHTGARPYQCAACGKAFGWRSTLLKHRSSHSGEKPHHCPVCGKAFGHGSLLAQHLRTHGGPRPHKCPVCAKGFGQGSALLKHLRTHTGERPYPCPQCGKAFGQSSALLQHQRTHTAERPYRCPHCGKAFGQSSNLQHHLRIHTGERPYACPHCSKAFGQSSALLQHLHVHSGERPYRCQLCGKAFGQASSLTKHKRVHEGAAAAAAAAAAAAAAAAAGLGLGPGLSPASMMRPGQVSLLGPDAVSVLGSGLGLSPGTSSGRNPDPGSGPGTLPDPSSKPLPGSRSTPSPTPVESSDPKAGHDAGPDLVPSPDLDPVPSPDPDPVPSPDPNPVSCPDPCSPTRGTVSPALPTGESPEWVQEQGALLGPDG

SEQ ID NO: 202 - protein, 810 aa, Homo sapiens
MIPVTELRYFADTQPAYRILKPWWDVFTDYISIVMLMIAVFGGTLQVTQDKMICLPCKWVTKDSCNDSFRGWAAPGPEPTYPNSTILPTPDTGPTGIKYDLDRHQYNYVDAVCYENRLHWFAKYFPYLVLLHTLIFLACSNFWFKFPRTSSKLEHFVSILLKCFDSPWTTRALSETVVEESDPKPAFSKMNGSMDKKSSTVSEDVEATVPMLQRTKSRIEQGIVDRSETGVLDKKEGEQAKALFEKVKKFRTHVEEGDIVYRLYMRQTIIKVIKFILIICYTVYYVHNIKFDVDCTVDIESLTGYRTYRCAHPLATLFKILASFYISLVIFYGLICMYTLWWMLRRSLKKYSFESIREESSYSDIPDVKNDFAFMLHLIDQYDPLYSKRFAVFLSEVSENKLRQLNLNNEWTLDKLRQRLTKNAQDKLELHLFMLSGIPDTVFDLVELEVLKLELIPDVTIPPSIAQLTGLKELWLYHTAAKIEAPALAFLRENLRALHIKFTDIKEIPLWIYSLKTLEELHLTGNLSAENNRYIVIDGLRELKRLKVLRLKSNLSKLPQVVTDVGVHLQKLSINNEGTKLIVLNSLKKMANLTELELIRCDLERIPHSIFSLHNLQEIDLKDNNLKTIEEIISFQHLHRLTCLKLWYNHIAYIPIQIGNLTNLERLYLNRNKIEKIPTQLFYCRKLRYLDLSHNNLTFLPADIGLLQNLQNLAITANRIETLPPELFQCRKLRALHLGNNVLQSLPSRVGELTNLTQIELRGNRLECLPVELGECPLLKRSGLVVEEDLFNTLPPEVKERLWRADKEQA

SEQ ID NO: 203 - protein, 527 aa, Homo sapiens
MENQEKASIAGHMFDVVVIGGGISGLSAAKLLTEYGVSVLVLEARDRVGGRTYTIRNEHVDYVDVGGAYVGPTQNRILRLSKELGIETYKVNVSERLVQYVKGKTYPFRGAFPPVWNPIAYLDYNNLWRTIDNMGKEIPTDAPWEAQHADKWDKMTMKELIDKICWTKTARRFAYLFVNINVTSEPHEVSALWFLWYVKQCGGTTRIFSVTNGGQERKFVGGSGQVSERIMDLLGDQVKLNHPVTHVDQSSDNIIIETLNHEHYECKYVINAIPPTLTAKIHFRPELPAERNQLIQRLPMGAVIKCMMYYKEAFWKKKDYCGCMIIEDEDAPISITLDDTKPDGSLPAIMGFILARKADRLAKLHKEIRKKKICELYAKVLGSQEALHPVHYEEKNWCEEQYSGGCYTAYFPPGIMTQYGRVIRQPVGRIFFAGTETATKWSGYMEGAVEAGERAAREVLNGLGKVTEKDIWVQEPESKDVPAVEITHTFWERNLPSVSGLLKIIGFSTSVTALGFVLYKYKLLPRS

SEQ ID NO: 204 - protein, 870 aa, Homo sapiens
MTADKEKKRSSSERRKEKSRDAARCRRSKETEVFYELAHELPLPHSVSSHLDKASIMRLAISFLRTHKLLSSVCSENESEAEADQQMDNLYLKALEGFIAVVTQDGDMIFLSENISKFMGLTQVELTGHSIFDFTHPCDHEEIRENLSLKNGSGFGKKSKDMSTERDFFMRMKCTVTNRGRTVNLKSATWKVLHCTGQVKVYNNCPPHNSLCGYKEPLLSCLIIMCEPIQHPSHMDIPLDSKTFLSRHSMDMKFTYCDDRITELIGYHPEELLGRSAYEFYHALDSENMTKSHQNLCTKGQVVSGQYRMLAKHGGYVWLETQGTVIYNPRNLQPQCIMCVNYVLSEIEKNDVVFSMDQTESLFKPHLMAMNSIFDSSGKGAVSEKSNFLFTKLKEEPEELAQLAPTPGDAIISLDFGNQNFEESSAYGKAILPPSQPWATELRSHSTQSEAGSLPAFTVPQAAAPGSTTPSATSSSSSCSTPNSPEDYYTSLDNDLKIEVIEKLFAMDTEAKDQCSTQTDFNELDLETLAPYIPMDGEDFQLSPICPEERLLAENPQSTPQHCFSAMTNIFQPLAPVAPHSPFLLDKFQQQLESKKTEPEHRPMSSIFFDAGSKASLPPCCGQASTPLSSMGGRSNTQWPPDPPLHFGPTKWAVGDQRTEFLGAAPLGPPVSPPHVSTFKTRSAKGFGARGPDVLSPAMVALSNKLKLKRQLEYEEQAFQDLSGGDPPGGSTSHLMWKRMKNLRGGSCPLMPDKPLSANVPNDKFTQNPMRGLGHPLRHLPLPQPPSAISPGENSKSRFPPQCYATQYQDYSLSSAHKVSGMASRLLGPSFESYLLPELTRYDCEVNVPVLGSSTLLQGGDLLRALDQAT

SEQ ID NO: 205 - protein, 592 aa, Homo sapiens
MGRGLLRGLWPLHIVLWTRIASTIPPHVQKSDVEMEAQKDEIICPSCNRTAHPLRHINNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 206 - protein, 835 aa, Homo sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCEYCGKVFKNCSNLTVHRRSHTGERPYKCELCNYACAQSSKLTRHMKTHGQVGKDVYKCEICKMPFSVYSTLEKHMKKWHSDRVLNNDIKTE

SEQ ID NO: 207 - protein, 378 aa, Homo sapiens
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 208 - protein, 230 aa, Homo sapiens
MARLALSPVPSHWMVALLLLLSAAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 209 - protein, 780 aa, Homo sapiens
MNVRIFYSVSQSPHSLLSLLFYCAILESRISATMPLFKLPAEEKQIDDAMRNFAEKVFASEVKDEGGRQEISPFDVDEICPISHHEMQAHIFHLETLSTSTEARRKKRFQGRKTVNLSIPLSETSSTKLSHIDEYISSSPTYQTVPDFQRVQITGDYASGVTVEDFEIVCKGLYRALCIREKYMQKSFQRFPKTPSKYLRNIDGEAWVANESFYPVFTPPVKKGEDPFRTDNLPENLGYHLKMKDGVVYVYPNEAAVSKDEPKPLPYPNLDTFLDDMNFLLALIAQGPVKTYTHRRLKFLSSKFQVHQMLNEMDELKELKNNPHRDFYNCRKVDTHIHAAACMNQKHLLRFIKKSYQIDADRVVYSTKEKNLTLKELFAKLKMHPYDLTVDSLDVHAGRQTFQRFDKFNDKYNPVGASELRDLYLKTDNYINGEYFATIIKEVGADLVEAKYQHAEPRLSIYGRSPDEWSKLSSWFVCNRIHCPNMTWMIQVPRIYDVFRSKNFLPHFGKMLENIFMPVFEATINPQADPELSVFLKHITGFDSVDDESKHSGHMFSSKSPKPQEWTLEKNPSYTYYAYYMYANIMVLNSLRKERGMNTFLFRPHCGEAGALTHLMTAFMIADDISHGLNLKKSPVLQYLFFLAQIPIAMSPLSNNSLFLEYAKNPFLDFLQKGLMISLSTDDPMQFHFTKEPLMEEYAIAAQVFKLSTCDMCEVARNSVLQCGISHEEKVKFLGDNYLEEGPAGNDIRRTNVAQIRMAYRYETWCYELNLIAEGLKSTE

SEQ ID NO: 210 - protein, 571 aa, Homo sapiens
MERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVVTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRGWGLLDTMEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLAFPEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 211 - protein, 623 aa, Homo sapiens
MECKIEGKEKYQHSLNLLNKIQNMKELAEMIDVVLTAEGEKFPCHRLVLAAFSPYFKAMFTCGLLECNQREVILYDITAESVSVLLNYMYNAALEINNANVQTVAMAAYFMQMEEVFSVCQKYMMDHMDASNCLGIYYFAKQIGAEDLSDRSKKYLYQHFAEVSLHEEILEIEVHQFLTLIKSDDLNISREESILDLVLRWVNHNKELRTVHLVELLKQVRLELVNPSFLRQALRRNTMLLCDADCVDIIQNAFKAIKTPQQHSLNLRYGMETTSLLLCIGNNSSGIRSRHRSYGDASFCYDPVSRKTYFISSPKYGEGLGTVCTGVVMENNTIIVAGEASASKLSRQKNKNVEIYRYHDRGNQFWEKLCTAEFRELYALGSIHNDLYVIGGQMKIKNQYLITNCVDKYSVERDNWKRVSPLPLQLACHAVVTVNNKLYVIGGWTPQMDLPDEEPDRLSNKLLQYDPSQDQWSVRAPMKYSKYRFSTAVVNSEIYVLGGIGCVGQDKGQVRKCLDVVEIYNPDGDFWREGPPMPSPLLSLRTNSTNAGAVDGKLYVCGGFHGADRHEVISKEILELDPWENQWNVVAINVLMHDSYDVCLVARMNPRDLIPPPSDLVEEGNEH

SEQ ID NO: 212 - protein, 946 aa, Homo sapiens
MVEGRVSEFLKKLGFSGGGRQYQALEKDEEEALIDEQSELKAIEKEKKVTALPPKEACKCQKEDLARAFCVDLHTGLSEFSVTQRRLAHGWNEFVADNSEPVWKKYLDQFKNPLILLLLGSALVSVLTKEYEDAVSIATAVLVVVTVAFIQEYRSEKSLEELTKMVPPECNCLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTSISALSLITLSTVFNLPSPLNAMQILWINIIMDGPPAQSLGVEPVDKDAFRQPPRSVRDTILSRALILKILMSAAIIISGTLFIFWKEMPEDRASTPRTTTMTFTCFVFFDLFNALTCRSQTKLIFEIGFLRNHMFLYSVLGSILGQLAVIYIPPLQRVFQTENLGALDLLFLTGLASSVFILSELLKLCEKYCCSPKRVQMHPEDV

SEQ ID NO: 213 - protein, 319 aa, Homo sapiens
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 214 - protein, 382 aa, Homo sapiens
MLKKISVGVAGDLNTVTMKLGCVLMAWALYLSLGVLWVAQMLLAAGCHAAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 215 - protein, 847 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 216 - protein, 135 aa, Homo sapiens
MPPNLTGYYRFVSQKNMEDYLQALNISLAVRKIALLLKPDKEIEHQGNHMTVRTLSTFRNYTVQFDVGVEFEEDLRSVDGRKCQTIVTWEEEHLVCVQKGEVPNRGWRHWLEGEMLYLELTARDAVCEQVFRKVR

SEQ ID NO: 217 - protein, 390 aa, Homo sapiens
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQRALDYGSQSGREGQGFHILIPTILGLFLLALLGLVVKRAVERRKALSRRARRLAVRMRALESSQRPRGSPRPRSQNNIYSACPRRARGADAAGTGEAPVPGPGAPLPPAPLQVSESPWLHAPSLKTSCEYVSLYHQPAAMMEDSDSDDYINVPA

SEQ ID NO: 218 - protein, 217 aa, Homo sapiens
MTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYRSSSLPRCCLHEGLHNGF

SEQ ID NO: 219 - protein, 553 aa, Homo sapiens
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 220 - protein, 451 aa, Homo sapiens
MNLEGGGRGGEFGMSAVSCGNGKLRQWLIDQIDSGKYPGLVWENEEKSIFRIPWKHAGKQDYNREEDAALFKAWALFKGKFREGIDKPDPPTWKTRLRCALNKSNDFEELVERSQLDISDPYKVYRIVPEGAKKGAKQLTLEDPQMSMSHPYTMTTPYPSLPAQQVHNYMMPPLDRSWRDYVPDQPHPEIPYQCPMTFGPRGHHWQGPACENGCQVTGTFYACAPPESQAPGVPTEPSIRSAEALAFSDCRLHICLYYREILVKELTTSSPEGCRISHGHTYDASNLDQVLFPYPEDNGQRKNIEKLLSHLERGVVLWMAPDGLYAKRLCQSRIYWDGPLALCNDRPNKLERDQTCKLFDTQQFLSELQAFAHHGRSLPRFQVTLCFGEEFPDPQRQRKLITAHVEPLLARQLYYFAQQNSGHFLRGYDLPEHISNPEDYHRSIRHSSIQE

SEQ ID NO: 221 - protein, 378 aa, Homo sapiens
MSKTMAMNLLEDWCRGMEVDIHRSLLVTGIPEDCGQAEIEETLNGVLSPLGPYRVLNKIFVREENVKAALIEVGEGVNLSTIPREFPGRGGVWRVVCRDPTQDAEFLKNLNEFLDAEGRTWEDVVRLLQLNHPTLSQNQHQPPENWAEALGVLLGAVVQIIFCMDAEIRSREEARAQEAAEFEEMAAWALAAGRKVKKEPGLAAEVGSALKAETPNNWNATEDQHEPTKPLVRRAGAKSRSRRKKQKKNSRQEAVPWKKPKGINSNSTANLEDPEVGDAESMAISEPIKGSRKPCVNKEELALKKPMAKCAWKGPREPPQDARAEAESPGGASESDQDGGHESPPKKKAVAWVSAKNPAPMRKKKKNPERFDLGDHPY

SEQ ID NO: 222 - protein, 1178 aa, Homo sapiens
MPRRRPPASGAAQFPERIATRSPDPIPLCTFQRQVSEMAEDGSEEIMFIWCEDCSQYHDSECPELGPVVMVKDSFVLSRARSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTDDKTFQCEMCFRFFSTNSNLSKHKKKHGDKKFACEVCSKMFYRKDVMLDHQRRHLEGVRRVKREDLEAGGENLVRYKKEPSGCPVCGKVFSCRSNMNKHLLTHGDKKYTCEICGRKFFRVDVLRDHIHVHFKDIALMDDHQREEFIGKIGISSEENDDNSDESADSEPHKYSCKRCQLTFGRGKEYLKHIMEVHKEKGYGCSICNRRFALKATYHAHMVIHRENLPDPNVQKYIHPCEICGRIFNSIGNLERHKLIHTGVKSHACEQCGKSFARKDMLKEHMRVHDNVREYLCAECGKGMKTKHALRHHMKLHKGIKEYECKECHRRFAQKVNMLKHCKRHTGIKDFMCELCGKTFSERNTMETHKLIHTVGKQWTCSVCDKKYVTEYMLQKHVQLTHDKVEAQSCQLCGTKVSTRASMSRHMRRKHPEVLAVRIDDLDHLPETTTIDASSIGIVQPELTLEQEDLAEGKHGKAAKRSHKRKQKPEEEAGAPVPEDATFSEYSEKETEFTGSVGDETNSAVQSIQQVVVTLGDPNVTTPSSSVGLTNITVTPITTAAATQFTNLQPVAVGHLTTPERQLQLDNSILTVTFDTVSGSAMLHNRQNDVQIHPQPEASNPQSVAHFINLTTLVNSITPLGSQLSDQHPLTWRAVPQTDVLPPSQPQAPPQQAAQPQVQAEQQQQQMYSY

SEQ ID NO: 223 - protein, 375 aa, Homo sapiens
MKVWLLLGLLLVHEALEDVTGQHLPKNKRPKEPGENRIKPTNKKVKPKIPKMKDRDSANSAPKTQSIMMQVLDKGRFQKPAATLSLLAGQTVELRCKGSRIGWSYPAYLDTFKDSRLSVKQNERYGQLTLVNSTSADTGEFSCWVQLCSGYICRKDEAKTGSTYIFFTEKGELFVPSPSYFDVVYLNPDRQAVVPCRVTVLSAKVTLHREFPAKEIPANGTDIVYDMKRGFVYLQPHSEHQGVVYCRAEAGGRSQISVKYQLLYVAVPSGPPSTTILASSNKVKSGDDISVLCTVLGEPDVEVEFTWIFPGQKDERPVTIQDTWRLIHRGLGHTTRISQSVITVEDFETIDAGYYICTAQNLQGQTTVATTVEFS

SEQ ID NO: 224 - protein, 1248 aa, Homo sapiens
MGKDQELLEAARTGNVALVEKLLSGRKGGILGGGSGPLPLSNLLSIWRGPNVNCTDSSGYTALHHAALNGHKDIVLKLLQYEASTNVADNKGYFPIHLAAWKGDVEIVKILIHHGPSHSRVNEQNNENETALHCAAQYGHSEVVAVLLEELTDPTIRNSKLETPLDLAALYGRLRVVKMIISAHPNLMSCNTRKHTPLHLAARNGHKAVVQVLLEAGMDVSCQTEKGSALHEAALFGKVDVVRVLLETGIDANIKDSLGRTVLDILKEHPSQKSLQIATLLQEYLEGVGRSTVLEEPVQEDATQETHISSPVESPSQKTKSETVTGELSKLLDEIKLCQEKDYSFEDLCHTISDHYLDNLSKISEEELGKNGSQSVRTSSTINLSPGEVEEEDDDENTCGPSGLWEALTPCNGCRNLGFPMLAQESYPKKRNYTMEIVPSASLDTFPSENENFLCDLMDTAVTKKPCSLEIARAPSPRTDNASEVAVTTPGTSNHRNSSTGPTPDCSPPSPDTALKNIVKVIRPQPKQRTSIVSSLDFHRMNHNQEYFEINTSTGCTSFTASPPASPPTSSVGTTEVKNEGTNHTDDLSRQDDNDPPKEYDPGQFAGLLHGSSPACESPENPFHLYGKREQCEKGQDEVSLANSPLPFKQSPIENNSEPLVKKIKPKVVSRTIFHKKSNQLENHTIVGTRSTRSGSRNGDQWVMNAGGFVERACTLGRIRSLPKALIDMHLSKSVSKSDSDLIAYPSNEKTSRVNWSESSTAEHSSKGNSERTPSFTSEWEEIDKIMSSIDVGINNELKEMNGETTRPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 225 - protein, 491 aa, Homo sapiens
MIATGGVITGLAALKRQDSARSQQHVNLSPSPATQEKKPIRRRPRADVVVVRGKIRLYSPSGFFLILGVLISIIGIAMAVLGYWPQKEHFIDAETTLSTNETQVIRNEGGVVVRFFEQHLHSDKMKMLGPFTMGIGIFIFICANAILHENRDKETKIIHMRDIYSTVIDIHTLRIKEQRQMNGMYTGLMGETEVKQNGSSCASRLAANTIASFSGFRSSFRMDSSVEEDELMLNEGKSSGHLMPPLLSDSSVSVFGLYPPPSKTTDDKTSGSKKCETKSIVSSSISAFTLPVIKLNNCVIDEPSIDNITEDADNLKSRSRNLSMDSLVVPLPNTSESFQPVSTVLPRNNSIGESLSSQYKSSMALGPGAGQLLSPGAARRQFGSNTSLHLLSSHSKSLDLDRGPSTLTVQAEQRKHPSWPRLDRNNSKGYMKLENKEDPMDRLLVPQVAIKKDFTNKEKLLMISRSHNNLSFEHDEFLSNNLKRGTSETRF

SEQ ID NO: 226 - protein, 183 aa, Homo sapiens
MKLLSLVAVVGCLLVPPAEANKSSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 227 - protein, 344 aa, Homo sapiens
MGTRQTKGSLAERASPGAAPGPRRERPDFWASLLLRAGDKAGRAGAGMPPYHRRVGMVQELLRMVRQGRREEAGTLLQHLRQDLGMESTSLDDVLYRYASFRNLVDPITHDLIISLARYIHCPKPEGDALGAMEKLCRQLTYHLSPHSQWRRHRGLVKRKPQACLKAVLAGSPPDNTVDLSGIPLTSRDLERVTSYLQRCGEQVDSVELGFTGLTDDMVLQLLPALSTLPRLTTLALNGNRLTRAVLRDLTDILKDPSKFPNVTWIDLGNNVDIFSLPQPFLLSLRKRSPKQGHLPTILELGEGPGSGEEVREGTVGQEDPGGGPVAPAEDHHEGKETVAAAQT

SEQ ID NO: 228 - protein, 621 aa, Homo sapiens
MLMAGQRGAWTMGDVVEKSLEGPLAPSTDEPSQKTGDLVEILNGEKVKFDDAGLSLILQNGLETLRMENALTDVILCVDIQEFSCHRVVLAAASNYFRAMFCNDLKEKYEKRIIIKGVDAETMHTLLDYTYTSKALITKQNVQRVLEAANLFQFLRMVDACASFLTEALNPENCVGILRLADTHSLDSLKKQVQSYIIQNFVQILNSEEFLDLPVDTLHHILKSDDLYVTEEAQVFETVMSWVRHKPSERLCLLPYVLENVRLPLLDPWYFVETVEADPLIRQCPEVFPLLQEARMYHLSGNEIISERTKPRMHEFQSEVFMIIGGCTKDERFVAEVTCLDPLRRSRLEVAKLPLTEHELESENKKWVEFACVTLKNEVYISGGKETQHDVWKYNSSINKWIQIEYLNIGRWRHKMVVLGGKVYVIGGFDGLQRINNVETYDPFHNCWSEAAPLLVHVSSFAATSHKKKLYVIGGGPNGKLATDKTQCYDPSTNKWSLKAAMPVEAKCINAVSFRDRIYVVGGAMRALYAYSPLEDSWCLVTQLSHERASCGIAPCNNRLYITGGRDEKNEVIATVLCWDPEAQKLTEECVLPRGVSHHGSVTIRKSYTHIRRIVPGAVSV

SEQ ID NO: 229 - protein, 735 aa, Homo sapiens
MTAGSSYPLFLAAYACTGCLAERLGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 230 - protein, 271 aa, Homo sapiens
MAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRLLPVQENFLLKFQGMKLTSEEFNAIFTFYDKDRSGYIDEHELDALLKDLYEKNKKEMNIQQLTNYRKSVMSLAEAGKLYRKDLEIVLCSEPPM

SEQ ID NO: 231 - protein, 226 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 232 - protein, 226 aa, Homo sapiens
MADPQAGSAAGDWEIDVESLELEEDVCGAPRSTPPGPSPPPADGDCEDDEDDDGVDEDAEEEGDGEEAGASPGMPGQPEQRGGPQPRPPLAPQASPAGTGPRERCTPAGGGAEPRKLSRTPKCARCRNHGVVSCLKGHKRFCRWRDCQCANCLLVVERQRVMAAQVALRRQQATEDKKGLSGKQNNFERKAVYQRQVRAPSLLAKSILEVLLGLFYSYYVYIMNHL

SEQ ID NO: 233 - protein, 109 aa, Homo sapiens
MKFISTSLLLMLLVSSLSPVQGVLEVYYTSLRCRCVQESSVFIPRRFIDRIQILPRGNGCPRKEIIVWKKNKSIVCVDPQAEWIQRMMEVLRKRSSSTLPVPVFKRKIP

SEQ ID NO: 234 - protein, 541 aa, Homo sapiens
MKSYTPYFILLWSAVGIAKAAKIIIVPPIMFESHMYIFKTLASALHERGHHTVFLLSEGRDIAPSNHYSLQRYPGIFNSTTSDAFLQSKMRNIFSGRLTAIELFDILDHYTKNCDLMVGNHALIQGLKKEKFDLLLVDPNDMCGFVIAHLLGVKYAVFSTGLWYPAEVGAPAPLAYVPEFNSLLTDRMNLLQRMKNTGVYLISRLGVSFLVLPKYERIMQKYNLLPEKSMYDLVHGSSLWMLCTDVALEFPRPTLPNVVYVGGILTKPASPLPEDLQRWVNGANEHGFVLVSFGAGVKYLSEDIANKLAGALGRLPQKVIWRFSGPKPKNLGNNTKLIEWLPQNDLLGHSKIKAFLSHGGLNSIFETMYHGVPVVGIPLFGDHYDTMTRVQAKGMGILLEWKTVTEKELYEALVKVINNPSYRQRAQKLSEIHKDQPGHPVNRTIYWIDYIIRHNGAHHLRAAVHQISFCQYFLLDIAFVLLLGAALLYFLLSWVTKFIYRKIKSLWSRNKHSTVNGHYHNGILNGKYKRNGHIKHEKKVK

SEQ ID NO: 235 - protein, 453 aa, Homo sapiens
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSYAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHK

SEQ ID NO: 236 - protein, 630 aa, Homo sapiens
MLMRKVPGFVPASPWGLRLPQKFLFLLFLSGLVTLCFGALFLLPHSSRLKRLFLAPRTQQPGLEVVAEIAGHAPAREQEPPPNPAPAAPAPGEDDPSSWASPRRRKGGLRRTRPTGPREEATAARGNSIPASRPGDEGVPFRFDFNAFRSRLRHPVLGTRADESQEPQSQVRAQREKIKEMMQFAWQSYKRYAMGKNELRPLTKDGYEGNMFGGLSGATVIDSLDTLYLMELKEEFQEAKAWVGESFHLNVSGEASLFEVNIRYIGGLLSAFYLTGEEVFRIKAIRLGEKLLPAFNTPTGIPKGVVSFKSGNWGWATAGSSSILAEFGSLHLEFLHLTELSGNQVFAEKVRNIRKVLRKIEKPFGLYPNFLSPVSGNWVQHHVSVGGLGDSFYEYLIKSWLMSGKTDMEAKNMYYEALEAIETYLLNVSPGGLTYIAEWRGGILDHKMGHLACFSGGMIALGAEDAKEEKRAHYRELAAQITKTCHESYARSDTKLGPEAFWFNSGREAVATQLSESYYILRPEVVESYMYLWRQTHNPIYREWGWEVVLALEKYCRTEAGFSGIQDVYSSTPNHDNKQQSFFLAETLKYLYLLFSEDDLLSLEDWVFNTEAHPLPVNHSDSSGRAWGRH

SEQ ID NO: 237 - protein, 887 aa, Homo sapiens
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQGGSFESPKKEKRSHRRWRSRAIGKDAKGTLQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 238 - protein, 189 aa, Homo sapiens
MRLSLPLLLLLLGAWAIPGGLGDRAPLTATAPQLDDEEMYSAHMPAHLRCDACRAVAYQMWQNLAKAETKLHTSNSGGRRELSELVYTDVLDRSCSRNWQDYGVREVDQVKRLTGPGLSEGPEPSISVMVTGGPWPTRLSRTCLHYLGEFGEDQIYEAHQQGRGALEALLCGGPQGACSEKVSATREEL

SEQ ID NO: 239 - protein, 239 aa, Homo sapiens
MAWQGLAAEFLQVPAVTRAYTAACVLTTAAVQLELLSPFQLYFNPHLVFRKFQVWRLVTNFLFFGPLGFSFFFNMLFVFRYCRMLEEGSFRGRTADFVFMFLFGGVLMTLLGLLGSLFFLGQALMAMLVYVWSRRSPRVRVNFFGLLTFQAPFLPWALMGFSLLLGNSILVDLLGIAVGHIYYFLEDVFPNQPGGKRLLQTPGFLGLQSSKAPAGSSLTIWTQQSQGGPGTAGELAAPS

SEQ ID NO: 240 - protein, 1250 aa, Homo sapiens
MARGDAGRGRGLLALTFCLLAARGELLLPQETTVELSCGVGPLQVILGPEQAAVLNCSLGAAAAGPPTRVTWSKDGDTLLEHDHLHLLPNGSLWLSQPLAPNGSDESVPEAVGVIEGNYSCLAHGPLGVLASQTAVVKLATLADFSLHPESQTVEENGTARFECHIEGLPAPIITWEKDQVTLPEEPRLIVLPNGVLQILDVQESDAGPYRCVATNSARQHFSQEALLSVAHRGSLASTRGQDVVIVAAPENTTVVSGQSVVMECVASADPTPFVSWVRQDGKPISTDVIVLGRTNLLIANAQPWHSGVYVCRANKPRTRDFATAAAELRVLAAPAITQAPEALSRTRASTARFVCRASGEPRPALRWLHNGAPLRPNGRVKVQGGGGSLVITQIGLQDAGYYQCVAENSAGMACAAASLAVVVREGLPSAPTRVTATPLSSSAVLVAWERPEMHSEQIIGFSLHYQKARGMDNVEYQFAVNNDTTELQVRDLEPNTDYEFYVVAYSQLGASRTSTPALVHTLDDVPSAAPQLSLSSPNPSDIRVAWLPLPPSLSNGQVVKYKIEYGLGKEDQIFSTEVRGNETQLMLNSLQPNKVYRVRISAGTAAGFGAPSQWMHHRTPSMHNQSHVPFAPAELKVQAKMESLVVSWQPPPHPTQISGYKLYWREVGAEEEANGDRLPGGRGDQAWDVGPVRLKKKVKQYELTQLVPGRLYEVKLVAFNKHEDGYAAVWKGKTEKAPAPDMPIQRGPPLPPAHVHAESNSSTSIWLRWKKPDFTTVKIVNYTVRFSPWGLRNASLVTYYTSSGEDILIGGLKPFTKYEFAVQSHGVDMDGPFGSVVERSTLPDRPSTPPSDLRLSPLTPSTVRLHWCPPTEPNGEIVEYLILYSSNHTQPEHQWTLLTTQGNIFSAEVHGLESDTRYFFKMGARTEVGPGPFSRLQDVITLQEKLSDSLDMHSVTGIIVGVCLGLLCLLACMCAGLRRSPHRESLPGLSSTATPGNPALYSRARLGPPSPPAAHELESLVHPHPQDWSPPPSDVEDRAEVHSLMGGGVSEGRSHSKRKISWAQPSGLSWAGSWAGCELPQAGPRPALTRALLPPAGTGQTLLLQALVYDAIKGNGRKKSPPACRNQVEAEVIVHSDFSASNGNPDLHLQDLEPEDPLPPEAPDLISGVGDPGQGAAWLDRELGGCELAAPGPDRLTCLPEAASASCSYPDLQPGEVLEETPGDSCQLKSPCPLGASPGLPRSPVSSSA

SEQ ID NO: 241 - protein, 244 aa, Homo sapiens
MHYGAATHIQNSRSHGLETVPGHQRLERGAGGETPEFPGCHSPAPPENFGNELLPLSAPLQGLSEGLYPPGRNKTLPAGVLREGAVQFLHRGLCNSNLSSEASARPSGTQDELHSSRRKTGQTRREGARKHLVCSFRLYPFTVHTVSPGNSHLALYQVFKAVKLCPSETSFFLSRKSLKSSDPWHPPSLSPNSWNRQAGFRAWSSHLISLSLTCSDSQSRRVSSSQQPPLHSLSSHRRAAHVPE

SEQ ID NO: 242 - protein, 207 aa, Homo sapiens
MLLITLSANLFTVPERSLTTTFSFSRYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 243 - protein, 471 aa, Homo sapiens
MNYDSQQPPLPPLPYAGCRRASGFPALGRGGTVPVGVWGGAGQGREGRSWGEGPRGPGLGRRDLSSADPAVLGATMESRCYGCAVKFTLFKKEYGCKNCGRAFCSGCLSFSAAVPRTGNTQQKVCKQCHEVLTRGSSANASKWSPPQNYKKRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPAASLQNDLNQGGPGSTNSKRQANWSLEEEKSRLLAEAALELREENTRQERILALAKRLAMLRGQDPERVTLQDYRLPDSDDDEDEETAIQRVLQQLTEEASLDEASGFNIPAEQASRPWTQPRGAEPEAQDVDPRPEAEEEELPWCCICNEDATLRCAGCDGDLFCARCFREGHDAFELKEHQTSAYSPPRAGQEH

SEQ ID NO: 244 - protein, 1092 aa, Homo sapiens
MGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKGCQSPPGLHHGRHTGGNTVFFVSGMTVDYTCDPGYLLVGNKSIHCMPSGNWSPSAPRCEETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRARNYYTDTSQKEAFHLEAREVYSVDPYNPAS

SEQ ID NO: 245 - protein, 910 aa, Homo sapiens
MKVGVLWLISFFTFTDGHGGFLGKNDGIKTKKELIVNKKKHLGPVEEYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRNGSIVAGYEVVGSSSASELLSAIEHVAEKAKTALHKLFPLEDGSFRVFGKAQCNDIVFGFGSKDDEYTLPCSSGYRGNITAKCESSGWQVIRETCVLSLLEELNKNFSMIVGNATEAAVSSFVQNLSVIIRQNPSTTVGNLASVVSILSNISSLSLASHFRVSNSTMEDVISIADNILNSASVTNWTVLLREEKYASSRLLETLENISTLVPPTALPLNFSRKFIDWKGIPVNKSQLKRGYSYQIKMCPQNTSIPIRGRVLIGSDQFQRSLPETIISMASLTLGNILPVSKNGNAQVNGPVISTVIQNYSINEVFLFFSKIESNLSQPHCVFWDFSHLQWNDAGCHLVNETQDIVTCQCTHLTSFSILMSPFVPSTIFPVVKWITYVGLGISIGSLILCLIIEALFWKQIKKSQTSHTRRICMVNIALSLLIADVWFIVGATVDTTVNPSGVCTAAVFFTHFFYLSLFFWMLMLGILLAYRIILVFHHMAQHLMMAVGFCLGYGCPLIISVITIAVTQPSNTYKRKDVCWLNWSNGSKPLLAFVVPALAIVAVNFVVVLLVLTKLWRPTVGERLSRDDKATIIRVGKSLLILTPLLGLTWGFGIGTIVDSQNLAWHVIFALLNAFQGFFILCFGILLDSKLRQLLFNKLSALSSWKQTEKQNSSDLSAKPKFSKPFNPLQNKGHYAFSHTGDSSDNIMLTQFVSNE

SEQ ID NO: 246 - protein, 538 aa, Homo sapiens
MSSPLASELSELAALRPGFRLSAPHARVAPRAATHARGRGRASHAGQPRLRSSCPGPSPGKRRVVPSGGAQPRVLPALSSRSHLFPMASHPQTRIQAYLEKNKIGPLFEELMTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLKMEPKNKGLKQQQQQHKKLLAAMLSQDSFESIHSPTPSVTEEDIDNEDDAMELLEDLNDLRMEGVTTLVPSGSKFNQGRPTYPAEPQAKVTLNICSRCARLQGDNLEERTEESLPILHSPDEKIPDSFDSLPGTEEALMEEGDEFEKASKLTGPGEASSGVGHSLKNYMEEDESLKQLQVVHQPWILPSDTESEGVEAEQEKRSADLLLCVPCSSCPTLVYSGL

SEQ ID NO: 247 - protein, 1093 aa, Homo sapiens
MPAAGSNEPDGVLSYQRPDEEAVVDQGGTSTILNIHYEKEELEGHRTLYVGVRMPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSECQEMHGEFMGSACGHHGPYTPDVLFWSCILFFTTFILSSTLKTFKTSRYFPTRVRSMVSDFAVFLTIFTMVIIDFLIGVPSPKLQVPSVFKPTRDDRGWIINPIGPNPWWTVIAAIIPALLCTILIFMDQQITAVIINRKEHKLKKGCGYHLDLLMVAIMLGVCSIMGLPWFVAATVLSITHVNSLKLESECSAPGEQPKFLGIREQRVTGLMIFVLMGCSVFMTAILKFIPMPVLYGVFLYMGVSSLQGIQFFDRLKLFGMPAKHQPDFIYLRHVPLRKVHLFTLIQLTCLVLLWVIKASPAAIVFPMMVLALVFVRKVMDLCFSKRELSWLDDLMPESKKKKLDDAKKKAKEEEEAEKMLEIGGDKFPLESRKLLSSPGKNISCRCDPSEINISDEMPKTTVWKALSMNSGNAKEKSLFN

SEQ ID NO: 248 - protein, 697 aa, Homo sapiens
MGPDRKEVPLSRGTQAVVVGKGRGAPGDDSSMGGRPSSPLDKQQRQHLRGQVDTLLRNFLPCYRGQLAASVLRQISRELGPQEPTGSQLLRSKKLPRVREHRGPLTQLRGHPPRWQPIFCVLRGDGRLEWFSHKEEYENGGHCLGSTALTGYTLLTSQREYLRLLDALCPESLGDHTQEEPDSLLEVPVSFPLFLQHPFRRHLCFSAATREAQHAWRLALQGGIRLQGTVLQRSQAPAARAFLDAVRLYRQHQGHFGDDDVTLGSDAEVLTAVLMREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKKFKSDSGLAQRRFIRGWGLCIFLPFVLSQLEPGCKKELPEFEGDVLAVGSQALTTEGIYEDVIRGCLLQRIDQELKKTLGANDVSCTLDGCLEVPWEQEGAAPNLNLVSSFLAGRQAFTDFLCLPAKSSANWILAASLLSCSCFRSGFHRDSRVFLVQLAEGLSHSLETVSSHSVWSFRPTPRQ

SEQ ID NO: 249 - protein, 229 aa, Homo sapiens
MRLNIAIFFGALFGALGVLLFLVAFGSDYWLLATEVGRCSGEKNIENVTFHHEGFFWRCWFNGIVEENDSNIWKFWYTNQPPSKNCTHAYLSPYPFMRGEHNSTSYDSAVIYRGFWAVLMLLGVVAVVIASFLIICAAPFASHFLYKAGGGSYIAAGILFSLVVMLYVIWVQAVADMESYRNMKMKDCLDFTPSVLYGWSFFLAPAGIFFSLLAGLLFLVVGWHIQIHH

SEQ ID NO: 250 - protein, 910 aa, Homo sapiens; identical to SEQ ID NO: 245

SEQ ID NO: 251 - protein, 583 aa, Homo sapiens
MDLMNGQASSVNIAATASEKSSSSESLSDKGSELKKSFDAVVFDVLKVTPEEYAGQITLMDVPVFKAIQPDELSSCGWNKKEKYSSAPNAVAFTRRFNHVSFWVVREILHAQTLKIRAEVLSHYIKTAKKLYELNNLHALMAVVSGLQSAPIFRLTKTWALLSRKDKTTFEKLEYVMSKEDNYKRLRDYISSLKMTPCIPYLGIYLSDLTYIDSAYPSTGSILENEQRSNLMNNILRIISDLQQSCEYDIPMLPHVQKYLNSVQYIEELQKFVEDDNYKLSLKIEPGTSTPRSAASREDLVGPEVGASPQSGRKSVAAEGALLPQTPPSPRNLIPHGHRKCHSLGYNFIHKMNTAEFKSATFPNAGPRHLLDDSVMEPHAPSRGQAESSTLSSGISIGSSDGSELSEETSWPAFERNRLYHSLGPVTRVARNGYRSHMKASSSAESEDLAVHLYPGAVTIQGVLRRKTLLKEGKKPTVASWTKYWAALCGTQLFYYAAKSLKATERKHFKSTSNKNVSVIGWMVMMADDPEHPDLFLLTDSEKGNSYKFQAGNRMNAMLWFKHLSAACQSNKQQVPTNLMTFE

SEQ ID NO: 252 - protein, 27 aa, Homo sapiens
MHSAKRWLVKDQWHGEVSPGCTAFAAV

SEQ ID NO: 253 - DNA, 3739 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcaaaaaaaaaa

SEQ ID NO: 254 - DNA, 3794 bp, Homo sapiens
gagccagcccagccgcgttccgaacgtgagggtcgccggcctgggcgctgtcacgtcggggctgccggagctgcgggggaccgggcccgaacggcccctgacacctgcggtctcccgccgggctgggcaagcgcagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcaaaaaaaaaa

SEQ ID NO: 255 - DNA, 3874 bp, Homo sapiens
ctaggcggcggcggccgggtccccaaggctgggcgctgcttgcggaaccgacggggcggagaggagcgtggcgggaggaggagtaggagaagggggctggtcaagggaagtgcgacgtgtctgcggagcctttttatacctccttcccgggagtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatggcatggcccttcctgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaaaatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaaaaaaaaaaaaaaaaaa

SEQ ID NO: 256 - DNA, 2819 bp, Homo sapiens
gcgcatgcagcccttcccaagcactggtagggcactgggcatgcagacagcccaccagaagggaagaatcaggagaaaagggatgcaagatcccagagataaactgaagcacaagagggtaaaaactttgtccttggtcttacagccagaaagtggtgatgcaaagaacttagtccaagctttgatctgttctgcactgcctgccaaagcagaaccttgagaaatacccatgtttgggggatgagaagaagaagataaatcagcaaagaaaatagtgataagaaagatgcagaacccagggatatggagagccaattgtatttgtaaaacacttagaatggtgcctgacacgtgagttgctttgtctaattctagccctgtggtagctacccaagattgttgtaacctccagtgatcaagttctttggataagcaaagagggagggcattaagtgtgtggaaaagacccctcctctccactcttgttgcaaggactcaggatcctgccctctgagggtttacagaagtcattctcactatctcacactggccgtcttgacccagagcagttctttactttctcgggacacaaacgggatgaaagtccagggctgggacttcctccttggaatgtttgacaaggactgacgtactctaggccctttgaatcccggaagtccaggacacacccaaccttgattacagtgtccagaatgctggagcgtaggtgaaaggacaaaagccagacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccaggtaacccacagcatctgcctatatgccttttgggtcaaaagagcctggggaaagtgtgtgagtgatttaagataccaagacacattccttcctggaaatctccctccactatggtttggatatgacatagtcaagaggctaatcatgagactttgttcagtctgtcttcagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaaggaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttacctttacatgtttttcttttgaaatggatggagttctacctgcatgtcacagcactttgcattcatgattattagcttgaaacagtcagaaaaaagatggatgggtggagacagacaaggaagaggctccttggttcctagaggagtttccaaattctaggagaccctagagatgatccagtataacccctggtgtcacagaaacagacggagtccaaggtgggttcagctgcttgcctgaagtcagagttatctggtagacaacagcagtgggacttagatgtcttttt

SEQ ID NO: 257 - DNA, 1863 bp, Homo sapiens
acagtgtccagaatgctggagcgtaggtgaaaggacaaaagccagacacatttcaacatgagggacccactgacagattgtccgtataataaagtatacaagaacctaaaggagttttctcaaaatggagagaatttctgcaaacaggtcacatctgttcttcagcaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaaggaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttacctttacatgtttttcttttgaaatggatggagttctacctgcatgtcacagcactttgcattcatgattattagcttgaaacagtcagaaaaaagatggatgggtggagacagacaaggaagaggctccttggttcctagaggagtttccaaattctaggagaccctagagatgatccagtataacccctggtgtcacagaaacagacggagtccaaggtgggttcagctgcttgcctgaagtcagagttatctggtagacaacagcagtgggacttagatgtcttttt

SEQ ID NO: 258 - DNA, 1854 bp, Homo sapiens
ccagaatgctggagcgtaggtgaaaggacaaaagccagacacatttcaacatgagggacccactgacagattgtccgggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaaggaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttacctttacatgtttttcttttgaaatggatggagttctacctgcatgtcacagcactttgcattcatgattattagcttgaaacagtcagaaaaaagatggatgggtggagacagacaaggaagaggctccttggttcctagaggagtttccaaattctaggagaccctagagatgatccagtataacccctggtgtcacagaaacagacggagtccaaggtgggttcagctgcttgcctgaagtcagagttatctggtagacaacagcagtgggacttagatgtcttttt

SEQ ID NO: 259 - DNA, 2385 bp, Homo sapiens
agaatggcctcggacacccaggcagtccctgacgtgtcggggaggagccgggcgcggaggtacgctgagtggagctcggggctgcgtaggggagctgagccgagcggctgggcgggcctggccgggccggcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaaggaaaaaaaaaaa

SEQ ID NO: 260 - DNA, 2825 bp, Homo sapiens
cggaaacatgagagaggactatcatctgctccttgctctgaatttctttgaacctccatgctggaaccctcctcagttctccatgcaaacgttaaccaggcccctttgtggtgcttggtgctgcgctggtgcagagaatgcaaagacactgtctgtggtgggaaacagaaaagcagagtgaaccacacattccagcgccgggaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtgtaagtggaaataatgagattggtgttctcgtgggcatccttccactttaatgaaaataattccctatagattgagttttaattatacgaataatacatcaatccataaagatgtatgtaatcctgctctcctctacggaagtaacttttgctcaaagtttgatatggaaatccacaagccatttttttatgcatttgaaaatacctttttgacatcaaaatattccttctcaaaagagttttgtgtatgatctaaaacaaactttcaatacatttacaaaaatttaaaatgaaaaagggacacaatagaagttgttttatatataggtatttattaaaacttattcaattttttaaaaaagtaagcatttctttgggatataggaaattcaaagtgacatgaattaaaatgacaggaaataaaaacaaatgtattttagcacaaagtatcttcattggtgaaaagtaagcaaaccaaatcaagtcttaagcttaaataaacttatttatattttcaaaaaaaaaaaaaaaaa

SEQ ID NO: 261 - DNA, 2877 bp, Homo sapiens
aaaccaggcacaccattgatcaggctagaatgatgtggaccagtctcacagacaacagccaagcacagaggaaatattagctggcagagataacgaagagaaaacactcggtgacagatgcaccatctgtcagtttctgaggagcagttttcaagaaagctgaaaatgaattgaagaagagaggggttttgtttgaaaggtacagcacagcctaaggacaattttaaacaaaaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtgtaagtggaaataatgagattggtgttctcgtgggcatccttccactttaatgaaaataattccctatagattgagttttaattatacgaataatacatcaatccataaagatgtatgtaatcctgctctcctctacggaagtaacttttgctcaaagtttgatatggaaatccacaagccatttttttatgcatttgaaaatacctttttgacatcaaaatattccttctcaaaagagttttgtgtatgatctaaaacaaactttcaatacatttacaaaaatttaaaatgaaaaagggacacaatagaagttgttttatatataggtatttattaaaacttattcaattttttaaaaaagtaagcatttctttgggatataggaaattcaaagtgacatgaattaaaatgacaggaaataaaaacaaatgtattttagcacaaagtatcttcattggtgaaaagtaagcaaaccaaatcaagtcttaagcttaaataaacttatttatattttcaaaaaaaaaaaaaaaaa

SEQ ID NO: 262 - DNA, 6236 bp, Homo sapiens
ggctcttctcggggagtggagtgctatgacagatgagactttcatgcaagaaaataaatcctgcacatttgatgtactgctttaaacttaaagacctctttggacccgaaattgtaagatcctgagtggcaactggaaaggattcgtggttacttggatctaggaaaatcctgttttatctctgatgggactaagacaaagcactcctgttagtacaacccagcttgcgttcctccctgcctgcagaggaagcatttggatgcttcccttcccgttggaagttgccagtctctcttcagagtgatgagggcagaactggtcattacggaaagagtcggaggaacggtgccacagcatcaggttcaggttaaccacctgggacggtaaactaccgaagtctgcttctgcttccaaaggagaaccgcagtgaaaggattctataaacctggagagtaatcctaagaaaaatcatcagaagaaaggaatttgtagaactaaaactgcaaacatccagaatcttgatggtgtgccaagccaaatgtcaactggaactcaaccaaaaactaaagtgctctctgataacagacccaaagaaagagtggaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatatctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaatttatatatattaaatatttcctattttctataaaataaaa

SEQ ID NO: 263 - DNA, 5866 bp, Homo sapiens
aaaccaggcacaccattgatcaggctagaatgatgtggaccagtctcacagacaacagccaagcacagaggaaatattagctggcagagataacgaagagaaaacactcggtgacagatgcaccatctgtcagtttctgaggagcagttttcaagaaagctgaaaatgaattgaagaagagaggggttttgtttgaaaggtacagcacagcctaaggacaattttaaacaaaaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatatctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaatttatatatattaaatatttcctattttctataaaataaaa

SEQ ID NO: 264 - DNA, 5836 bp, Homo sapiens
cggaaacatgagagaggactatcatctgctccttgctctgaatttctttgaacctccatgctggaaccctcctcagttctccatgcaaacgttaaccaggcccctttgtggtgcttggtgctgcgctggtgcagagaatgcaaagacactgtctgtggtgggaaacagaaaagcagagtgaaccacacattccagcgccgggaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatatctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaatttatatatattaaatatttcctattttctataaaataaaa

SEQ ID NO: 265 - DNA, 4745 bp, Homo sapiens
acacatacatatgccactcacatccgacgtgtgtggttgctcagtagggaaatgcttacagctgcctctagaagcaagtccgctcgctgcatggagagggaaacatgagcatgcagcaggactagctgtcacctcccgcccgcctgcccagagagggccagagcgtcggggaggcaagatgatccaccagcggttccatcctacacttggattcagtaagctgtgaggtccgtaatgtcagacactggcaaacatcatatgttcttcaagtagagttatgaaaacgaagaaactggtcagaagagtaaaacgccggaattgtcctttccaacatccagagctgcatcattccttggggcaaaatgtggacaaggaatcttatggcaagggccttatatgacaatgtcccagagtgtgccgaggaactggcctttcgcaagggagacatcctgaccgtcatagagcagaacacagggggactggaaggatggtggctgtgctcattacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagttgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagtcaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcaccttagtaagcaccttctaatgctgcattttttttgttgttgttaaaaacataccagctggttataatattgttctccacgtccttgtgatgattctgagcctggcactcccaaatctgggaagcatagtttatttgcaagtgttcaccttccaaatcatgaggcatagcatgacttattcttgtttggaaaactcttttcaaaactgaccatcttaaacacatgatggccaagtgcccaaaagccctcttgcggagcaaatttcagaatatatatgtggatccaagctctgatagttcaggtgctggagggaagagagacctgtgtgtttagaggccaggaccacagttaggattgggttgtttcaatactgagagacagctacaataaaaggagagcaattgcctccctggggctgttcaatcttctgcatttgtgagtggttcagtcatgaggttttccaaaagatgtttttagagttgtaaaaaccatatttgcagcaaagatttacaaaggcgtatcagactatgattgttcaccaaaataggggaatggtttgatccgccagttgcaagtagaggcctttctgactcttaatattcactttggtgctactacccccattacctgagggaaactggccaggtccttgatcatggaactatagagctaccaggacatatcctgctctctaagggaatttattgctatcttgcaccttctttaaaactcacatatgcagacctgacactcaagagtggctagctacacagagtccatctaatttttgcaacttcctgtggccagtgtgtataaccccttccactatctcacagatagtcacagcgtccattccatagtctgtctcctcacatctgttagtattgacacagcacagacaccacaagccatcaggttcttcatggggcaggtgaaatacttctaccccatgggtaaatgtattcacatattaccaagagaagaagcacattatctatgatcttttggcccagttcttatttagcatttttattccagcctacttggaaacatgtttttatttgcaatatatgcctgactgaattaagcttgcttgttttaaacaaccaaatcattggaacagaaaaggatttaaaaaacaagaatgcatgatctcagagtgattaaaaaaaaatcagtggaaataaatgatcatagaaggtgcttttcaaaacaactgctattataattctcaaagtcctactctgccaaaagaagattaaaagtcatacattacattacaaggaaatgttcatgtgggaagagggttgctgaaaatcaacaacgcttgaagttaaaaagtgtgtctttgtagatttcattgtataatgtgtatttcttaggagatggctgacttgattgatctacgctaagtggagacatttcacatttttaaaaccaaatgttcaatctgtattactctttgccgtcttgtatgtagaggctatttttaaatcattaaatttttagatctctgttttcataaaaaaaaaaaaaaa

SEQ ID NO: 266 - DNA, 1329 bp, Homo sapiens
acaacagtgagctcagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcattacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgttccagagagatgggcaagtgtcctatttcttagtgagagcctctaaacaaaccagcttgtgaacctccactgaaaagatctcatctgatgagcattttaataaagtgtcctgagtttggaggcttgccgtctttctcttggataaatatcttcatctcctagacttggaaaaacacattttctcctggggtttcccattggcgtgtcttgagctgctctggtgataaccgtaataatgccaatactgatacgaacagcagaaaacagtaaccccaagaactctacagatgatcatcaaggaccactgtctcttaccatttgctgctttggtttgaaattctcactgcctcgtagatctcattttgagcactatacattcctaaagattgatttctttctatctgacttaaatttaggaatgattaaatcttcatttctcccatgatttgatcctaaaacattttgaaaggaaacagccttgagatctgtgattactaagacatacataacattcttatcacattagaaagcaagaattgactgttgcttgtcttgttcctgttgtcttgtcccctgaattcctgtttatctttgattgtatgtgggacattgtattttcagtacatttgtagaaataatgtgaagcctataaagatgttctctgcctccaaaaaaaaaaaaaaaaaaaaaaaaaaaaaa

SEQ ID NO: 267 - DNA, 2347 bp, Homo sapiens
gttccccgcgtgccaccaggaagctcgggccggccaagagcgtagactcttgagaggagtgagacaggtgcgcgccagccggccttcggggctttatgggaactgggccgtgcggcggtcccgccctcgtgcgcaggcgcagaaccgttgtgaccagagcggttgcgggctgagcggtttcgagccggcgtcggggagcggcggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagcccaggaggtcaaagctgaggtgagccatgattactccactgcactccagcctgggcaacagagccaggccctgtatcaaaaaaaaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaagaataaaaaaa

SEQ ID NO: 268 - DNA, 4320 bp, Homo sapiens
aagaaaaacagctgagagggcatcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccctttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctgggaaaaaaaaaaaaaa

SEQ ID NO: 269 - DNA, 4485 bp, Homo sapiens
aaacagccttttgggacctgtccccggacgaggactgcccccctccctcgggcaactactactgatgctgtccaggcatcgcccaaggggaaaggttgcagcggggtcggaaggcgcgggaggagtctggcggtgattgatgggaagggatgaatgaataaaagtacttgtctgatggcagcagagaccccgagcaaacggtggaggctacactgtctggcattctcgcagcgtttcgtcagagccggacccgcctgcagctcaagggaggcgtgctcctctcccagagcaggctggaacccagctgggttccgcctcccgggaaggtggtctccattcgtcgctctgcatctggtttgtcagatccgagaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccctttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctgggaaaaaaaaaaaaaa

SEQ ID NO: 270 - DNA, 2544 bp, Homo sapiens
aagaaaaacagctgagagggcatcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaaggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccctttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctgggaaaaaaaaaaaaaa

SEQ ID NO: 271 - DNA, 2593 bp, Homo sapiens
gcctctggctcctcagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtgcttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaaaaaaaaaaaaaaaaaa

SEQ ID NO: 272 - DNA, 6540 bp, Homo sapiens
cggcccagccgagccgggctgcttgtctggccggcggaggctgagcgcgaccctagcaagccgcggcgcccgccgaccagggacaagagcgactcctgggaccccactctgccccgcgccgccgcctcctcccctgttgtcgcggggacgctcaggcccgcgccgcccgggccacgattctcctcctctttctcccggaggggaaggaacggagaaagccgagcggcggctccgggagagagcgagccgaggcccctgcccccgaggctcggggcaggaggaggaggaggaggaggaggcggaggcggagggaagtgcgcgtcactctcgggaggagagtatttcacctccaggcagaggctgcggctgccagttgagtacgagcggcagctgcgggcgccggcaatcgagtggcttcctggccatggagaggagatctggacccgaggacgccagggactcctctccgtctccctggaccgctgtgtaggcacctgagttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaaggcgtttctctttcaggattccgggtagaggttgtagatggagtgaagctaaatttgctagatgatgttagtagttggaaacctggagaccagattgtggtcgcaagcacagactattccatgtaccaagcagaggagttcactcttcttccctgttctgaatgcagccattttcaggtcaaagtcaaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttctaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgttttttttttttgtatattgatgaatgagatcttacctattaaatatattattggattatggttcctgaaggtcattagagtgtgtgtgtgtgtgtgtgtgtgtgtgtgtgttttatgacttaaatatctttacgtgtgttttttagagcttggttctttaaagatttggagaagatatgtaaattaccaaggcacttggtttttctgttttatatactaataatcagggcctaagttaaataaaaatatgtgtgcatgtattttaaaaaaaaaaaaaaaaaa

SEQ ID NO: 273 - DNA, 3887 bp, Homo sapiens
agaccgccgctgctgtctgcggggtctggtgccggggcctgagtctctgctggctaagccgacgcctcagccgcctcagtcgcctcaatctcgccttccgccctcgctctccctccgcgccaccggaccccgtagccccgcgcgcccccagacctttaagccagatgatgaacttcctgcggcgccggctgtcggacagcagcttcatcgccaatctgcccaacggctacatgaccgacctgcagcggcccgagccccagcaaccgccgccgccgccgccccccggcccgggcgccgcctcggcctcggcggcgcccccgaccgcctcgccgggaccggagcggaggccgccgcccgcctcggcgcccgcgccgcagcccgcgccaacaccgtcggtgggcagcagcttcttcagctcgctgtcccaagcggtaaagcagacggccgcctcggctggcctggtggacgcgcccgctcccgcgccggcagccgccaggaaggccaaggtgctgctggtggtcgacgagccgcacgccgactgggccaagtgctttcggggcaaaaaagtccttggagattatgatatcaaggtggaacaggcagaattttcagagctcaacctggtggcccatgcagatggcacctatgctgtggatatgcaggttctccggaatggcacaaaggttgtccggtccttccggccagacttcgtgctcatccggcagcatgcatttggcatggcggagaatgaggacttccgccacctgatcattggtatgcagtatgcaggcctccccagcatcaactcactggaatccatatacaacttctgtgacaagccatgggtgtttgcccagctggtcgctatctataagacactgggaggagaaaagttccctctcattgaacagacatactaccccaaccacaaagagatgctgacactgcccacgttccctgtggtggtgaagattggccacgctcactcaggcatgggcaaggtcaaagtggaaaaccactacgacttccaggacattgccagcgtggtggctctcacccagacctatgccactgcagagcctttcattgactccaagtatgacatccgggtccagaagattggcaacaactacaaggcttacatgaggacatcgatctcagggaactggaagacgaacactggctctgcgatgctggagcagattgccatgtcagacaggtacaaactgtgggtggacacctgctctgagatgtttggcggcctggacatctgtgctgtcaaagctgtacatggcaaagatgggaaagactacatttttgaggtcatggactgtagcatgccactgattggggaacatcaggtggaggacaggcaactcatcaccgaactagtcatcagcaagatgaaccagctgctgtccaggactcctgccctgtctcctcagagacccctaacaacccagcagccacagagcggaacacttaaggatccggactcaagcaagaccccacctcagcggccaccccctcaaggttgtttacagtatattctcgactgtaatggcattgcagtagggccaaaacaagtccaagcttcttaaaatgattggtggttaatttttcaaagcagaaattttaagccaaaaacaaacgaaaggaaagcggggaggggaaaacagaccctcccactggtgccgttgctgcgttctttcaatgctgactggactgtgtttttcctatgcagtgtcagctcctctgtctggttgtttacctgttcctgttcgtgcttgtaatgctcacttatgttttctctgtataacttgtgattccagggctgtttgtcaacagtatacaaaagaattgtgcctctcccaagtccagtgtgactttatcttctgggtggtttgatagtgtttttaaaagtaatatataatgtggggtgaaatgggagtaggggggtggacaggggagaaacgaaaaccacaaaaagaaaacccaactcctctcctccccccaagctcagttaaatcccccacctccaactttccctccaccagtgtgcttgggatcttcaatgaactgtgcttttcgctttctttctgcatgactattgtaactagatagaacattaagagattttcaagatcaaacttccatagcttcatccactgaatttgaaggcatccacctttttctccatttgctaaaatttggtgcagtttgagtttatgtgaataggctggctgtgcctgtagagctcttgtgtttttagtgatgacatgaaatacaaagaacaagctatttccaggaatgtgttctgtattttacatcccagtgtaccctttattttattattaactaattaactatgagatttttaaaaaatggggccgctgatgtgcaatatcaaagtgaacttgtgagtattttgtgtgtgttgatctcagttgtttcttcattgttgctgtttctggatccagccatgtgtgcgcttgtgtggacctgaggctgctttctgttcccaaagcttgacctgtgtacagagataattccttggcaatgttggacatagaatgcagggagctactgaaggtctgtcagggatttgtccattctgctcttggcctctcctgaggcctcataatgggagaccaaatcaaaaatgtcccatgtcacttgagtgggtacactgcctacagaaccttgaggttgactcctgcttcagttctcagctgtttaccacagccctccagggtccaaagattgaggagctttctctttcctgggaggaactgtctcagatttagcttgtgtgtgttttggacagaggctccacagcggtggctcttgaggaatcctcaccagtttgttctcttccctctgacaagcagcacctgagcagatgctgaggcagttcattaaaccaggcctcagcttcagtgcctcatcttgccatctcccggccaggctgggaacgggcaccaagcagccgcctctaacaaacaccatggtccgtggaagttcatgccagcagcttgcctttgagaagaaatgctgctggctctatttttacattcccttccacctctatactgtcatgtcaccgttctgaactcccagatctgagaaggaactagtgttggtggtatgtaacaagagttacgtatccaggggcttgtgccttggtttctcctttgattgctggtaaattctgaggccacagagaaatgcattgagtgtgaatgttgtcatctgtaatccctccctcagctgataatggtagttgatctgttgtaaatatatacatatatgcatatttgcacttccagatgggttgcataagaatcaggtccttaaatacctcccaatctgatgaaacgatagaataaagtaacatttcccagaatggaggaatacattattttatcgtatatttttgtccaagcgatgagctgacggtggtattgcttctctgcatgttatcagtgtgtacatctggtgcttttcatgtgtcatttgtgagccacaaatgcaaagttgccatttgaattcagtcaggctacagggtggtgtcagtcaaggtctttcaggtgggggagaaattggttagggctcccactgccaaatgcaagcagatagcataacctgactgttatgtgccctcaggcagcatgcttagggacaactctgtggcctgggggacatctgtgtcacagtataggattgccattcaggtgttttgtacctatttctttcctgacgttgtcccctttttttgtactgatccaactgggagaacctcagccaatgctggaagtatgattgaagtacctctcttttgtgactcttgtacagcttaatgtgcaataaaggaaaagttatatctg

SEQ ID NO: 274 - DNA, 1808 bp, Homo sapiens
agcctagttacagattgcactgcgtcagactgttccacacccagaagacgtcaggtgacttcagtcctgctgcagttgtgcagcagaggagactgcagacttcggttgaggaaacgggtatttcatgtctcagggagtaggtttgtgcagttacagcttttctgttggtatgcataattaataattggagctgcaaagcagatcgtgacaagagatggacggtcagaagaaaaattggaaggacaaggttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaaaaaaaaaaaaaaaaaaaaaaaaaaaaa

SEQ ID NO: 275 - DNA, 2414 bp, Homo sapiens
agtccctgccctcccctggggagggtgagtcacgccaaactgggcggagagtccgctggcctcactcctagctcatctgggcggcggcggcaagtggggacagggcgggtggcgcatcaccggcgcggaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaaaaaaaaaaaaaaaaaaaaaaaaaaaaa

SEQ ID NO: 276 - DNA, 2471 bp, Homo sapiens
agtccctgccctcccctggggagggtgagtcacgccaaactgggcggagagtccgctggcctcactcctagctcatctgggcggcggcggcaagtggggacagggcgggtggcgcatcaccggcgcggaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaaaaaaaaaaaaaaaaaaaaaaaaaaaaa

SEQ ID NO: 277 - DNA, 4129 bp, Homo sapiens
gtgctcgtggggagctggccgagtggaaaacgtccacattgacccaaccgcagtgaagggagagcgcctccagtggtgtggtgcgtggagaaatgggaaggagagagttctgatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaaaaaaaaaaaaaaaaaaaaaaaaaaaaa

SEQ ID NO: 278 - DNA, 1026 bp, Homo sapiens
agcaagatggatctactgtggatcctgccctccctgtggcttctcctgcttggggggcctgcctgcctgaagacccaggaacaccccagctgcccaggacccagggaactggaagccagcaaagttgtcctcctgcccagttgtcccggagctccaggaagtcctggggagaagggagccccaggtcctcaagggccacctggaccaccaggcaagatgggccccaagggtgagccaggccccagaaactgccgggagctgttgagccagggcgccaccttgagcggctggtaccatctgtgcctacctgagggcagggccctcccagtcttttgtgacatggacaccgaggggggcggctggctggtgtttcagaggcgccaggatggttctgtggatttcttccgctcttggtcctcctacagagcaggttttgggaaccaagagtctgaattctggctgggaaatgagaatttgcaccagcttactctccagggtaactgggagctgcgggtagagctggaagactttaatggtaaccgtactttcgcccactatgcgaccttccgcctcctcggtgaggtagaccactaccagctggcactgggcaagttctcagagggcactgcaggggattccctgagcctccacagtgggaggccctttaccacctatgacgctgaccacgattcaagcaacagcaactgtgcagtgattgtccacggtgcctggtggtatgcatcctgttaccgatcaaatctcaatggtcgctatgcagtgtctgaggctgccgcccacaaatatggcattgactgggcctcaggccgtggtgtgggccacccctaccgcagggttcggatgatgcttcgatagggcactctggcagccagtgcccttatctctcctgtacagcttccggatcgtcagccaccttgcctttgccaaccacctctgcttgcctgtccacatttaaaaataaaatcattttagccctttcaaaaaaaaaaaaaaaaaaaaaaaaaaaaa

SEQ ID NO: 279 - DNA, 4126 bp, Homo sapiens
aggcggcagggagtagggaggcggcctccctgcctcccctccaaaaaaaactctgtgatttcctctgggcaggagggagccacggccagcggctgtcacacttcatggctcttactccacctctcttgctcctctctgcagggaccatgaccttgggctcccccaggaaaggccttctgatgctgctgatggccttggtgacccagggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctggaggccacccaacctccttcggagcagccgggaacagatggccagctggccctgatcctgggccccgtgctggccttgctggccctggtggccctgggtgtcctgggcctgtggcatgtccgacggaggcaggagaagcagcgtggcctgcacagcgagctgggagagtccagtctcatcctgaaagcatctgagcagggcgacagcatgttgggggacctcctggacagtgactgcaccacagggagtggctcagggctccccttcctggtgcagaggacagtggcacggcaggttgccttggtggagtgtgtgggaaaaggccgctatggcgaagtgtggcggggcttgtggcacggtgagagtgtggccgtcaagatcttctcctcgagggatgaacagtcctggttccgggagactgagatctataacacagtgttgctcagacacgacaacatcctaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgcagtgttgcatcgccgacctgggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggtcctctcaggcctagctcagatgatgcgggagtgctggtacccaaacccctctgcccgactcaccgcgctgcggatcaagaagacactacaaaaaattagcaacagtccagagaagcctaaagtgattcaatagcccaggagcacctgattcctttctgcctgcagggggctgggggggtggggggcagtggatggtgccctatctgggtagaggtagtgtgagtgtggtgtgtgctggggatgggcagctgcgcctgcctgctcggcccccagcccacccagccaaaaatacagctgggctgaaacctgatcccctgctgtctggcctgctcaaagcggcaggctccctgacgcctggctctctccccacccctatggccagcatggtgcaccccctaccactcccgggacaggatgcaaaagaggctccagagtcagagtgccaagccagggaatcccagtcccagactcagagcccgggcctgcactttgccccctgcccttgatcaaccccactgccccaccagagctgccagggtggcacagggccctgtccagcccctggcacacacttccctgccaggcctcagcctctagcataagctccagagagccagggcccatcagtttctctctgtggatttgtatctcagctccatgatgccttgggctttctgtctcctcaacaagagtgcagcttgctgaatgtcagctgcctgagagagctggggcctgacttactagggcattaaatcctaagaggtcctactgaggtgtggcaggatcacaggccagtggaaaaagggcaggtcagatgggcaaggcccaggactttcagattaactgagaggatatcgaggccaagcatggcagggggaaggtcagtgggtgtcaagagacccaggtctgaccccggatgtttgctccatgtgacaaaagcaggcctgtctcaggaccttttcttttcttttttccttctttttttttttgacacggagtttcgctcttgttgtccaggctagagtgcaatggcatgatcccagctcaccgcaacgtctacctcccaggttcaaatcattctcttgcctcagactcccgagtagctgggattacaggcacatgccaccatgcctggctaattttgtatatttagtagaaacagggtttcaccatgctggccatgctggtctcgaactcctgacctcaggtgttccacctacctcagcctcccaaagtgctggggttacaggtgtgagccatcgcgcctggccaggacctttgtttcttatctacatattggaagatttggtcctgatgtcctttgaggcttctttagctctagttctctgacacttcagcctatatcacagctaacttcttcagtctcatctattccttatgctccagcccctggcaatttgcctcaagatgggggtttgaaaataactttacctgactcaaggagtgtctggagcacctcctagtctaagtctgcaagctccagttcttgcctaaaaccatgccagtggccacccttgggctcagacagctctgggccttttgaccacaagccagcccctcgccctctctgtggcatagtcttctctgccccaggactgcagggcggcttcctccaaggcttccaaggctcaaaagaaatttggctccatccaagaaggctccagctcccctactggcccctggctcaggcccacacccctggccaggcccagagagtgtgtctcaggagaattcaatggctctagagagacacacagaaagtttggcatttggaaatttcaaggatgtatgtatgctcacgtatggagcaggttgtcctggtccctgggtgcagggaagtgggctgcagggaagtggattggaggggagcttgaggaatataaggagcgggggtggagactcaggctatggacaaggacagccccaaggttgggaagacctggccttagtcgtcctcagcctaggggcagggcagtgaagaaagctctccccgctcctgctgtaatgacccagagtagcctccccaggccggcatcttatgtgtgtcttccaccatcctcatggtggcacttttctaggcctgtctcccagcattgtgcaaggctcggaagagaaccaggaagtgaaactgggtgaaaacagaaagctcaatggatgggctaggttcccagatcattagggcagagtttgcacgtcctctggtcactggaatccacccagcccacgaatcatctccctcttgaaggattttatttctactgggttttggaacaaactcctgctgagaccccacagccagaaactgaaagcagcagctccccaaagcctggaaaatccctaagagaaggcctggggcaggaagtggagtgacaggggacaggtagagagaagggggcccaatggccagggagtgaaggaggtggcgttgctgagagcagtctgcacatgcttctgtctgagtgcaggaaggtgttccagggtcgaaattacacttctcgtacctggagacgctgtttgtgggagcactgggctcatgcctggcacacaataggtctgcaataaaccatggttaaatcctga

SEQ ID NO: 280 - DNA, 5911 bp, Homo sapiens
agccgcgcagacgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccacttcgacgcatcctgtggccaccccaacaagctcgggacatgaccatcttatgaaaatttcaagcagttcaagcactgtggctatccctggctacaccttcacaagcccggggatgaccaccaccctaccgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcatcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtccagattcctcttgtaaaataacccactagtgcctgagctcagtgctgctggatgatgagggagatcaagaaaaagccacgtaagggactttatagatgaactagtggaatcccttcattctgcagtgagattgccgagacctgaagagggtaagtgacttgcccaaggtcagagccacttggtgacagagccaggatgagaacaaagattccatttgcaccatgccacactgctgtgttcacatgtgccttccgtccagagcagtcccgggcaggggtgaaactccagcaggtggctgggctggaaaggagggcagggctacatcctggctcggtgggatctgacgacctgaaagtccagctcccaagttttccttctcctaccccagcctcgtgtacccatcttcccaccctctatgttcttacccctccctacactcagtgtttgttcccacttactctgtcctggggcctctgggattagcacaggttattcataaccttgaaccccttgttctggattcggattttctcacatttgcttcgtgagatgggggcttaacccacacaggtctccgtgcgtgaaccaggtctgcttaggggacctgcgtgcaggtgaggagagaaggggacactcgagtccaggctggtatctcagggcagctgatgaggggtcagcaggaacactggcccattgcccctggcactccttgcagaggccacccacgatcttctttgggcttccatttccaccagggactaaaatctgctgtagctagtgagagcagcgtgttccttttgttgttcactgctcagctgatgggagtgattccctgagacccagtatgaaagagcagtggctgcaggagaggccttcccggggccccccatcagcgatgtgtcttcagagacaatccattaaagcagccaggaaggacaggctttcccctgtatatcataggaaactcagggacatttcaagttgctgagagttttgttatagttgttttctaacccagccctccactgccaaaggccaaaagctcagacagttggcagacgtccagttagctcatctcactcactctgattctcctgtgccacaggaaaagagggcctggaaagcgcagtgcatgctgggtgcatgaagggcagcctgggggacagactgttgtgggaacgtcccactgtcctggcctggagctaggccttgctgttcctcttctctgtgagcctagtggggctgctgcggttctcttgcagtttctggtggcatctcaggggaacacaaagctatgtctattccccaatataggacttttatgggctcggcagttagctgccatgtagaaggctcctaagcagtgggcatggtgaggtttcatctgattgagaagggggaatcctgtgtggaatgttgaactttcgccatggtctccatcgttctgggcgtaaattccctgggatcaagtaggaaaatgggcagaactgcttaggggaatgaaattgccatttttcgggtgaaacgccacacctccagggtcttaagagtcaggctccggctgtagtagctctgatgaaataggctatccactcgggatggcttactttttaaaagggtagggggaggggctggggaagatctgtcctgcaccatctgcctaattccttcctcacagtctgtagccatctgatatcctaggggaaaaggaaggccaggggttcacatagggccccagcgagtttcccaggagttagagggatgcgaggctaacaagttccaaaaacatctgccccgatgctctagtgtttggaggtgggcaggatggagaacagtgcctgtttgggggaaaacaggaaatcttgttaggcttgagtgaggtgtttgcttccttcttgcccagcgctgggttctctccacccagtaggttttctgttgtggtcccgtgggagaggccagactggattattcctcctttgctgatcctgggtcacacttcaccagccagggcttttgacggagacagcaaataggcctctgcaaatcaatcaaaggctgcaaccctatggcctcttggagacagatgatgactggcaaggactagagagcaggagtgcctggccaggtcggtcctgactctcctgactctccatcgctctgtccaaggagaacccggagaggctctgggctgattcagaggttactgctttatattcgtccaaactgtgttagtctaggcttaggacagcttcagaatctgacaccttgccttgctcttgccaccaggacacctatgtcaacaggccaaacagccatgcatctataaaggtcatcatcttctgccacctttactgggttctaaatgctctctgataattcagagagcattgggtctgggaagaggtaagaggaacactagaagctcagcatgacttaaacaggttgtagcaaagacagtttatcatcagctctttcagtggtaaactgtggtttccccaagctgcacaggaggccagaaaccacaagtatgatgactaggaagcctactgtcatgagagtggggagacaggcagcaaagcttatgaaggaggtacagaatattctttgcgttgtaagacagaatacgggtttaatctagtctaggcaccagatttttttcccgcttgataaggaaagctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacaggaatgtaaatgtcttactggaaatgacaagtttttgcttgatttttttttttaaacaaaaaatgaaatataacaagacaaacttatgataaagtatttgtcttgtagatcaggtgttttgttttgtttttttaattttaaaatgcaaccctgccccctccccagcaaagtcacagctccatttcagtaaaggttggagtcaatatgctctggttggcaggcaaccctgtagtcatggagaaaggtatttcaagatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaagaattgctactcgaaggtgccagaatgacacaaaggacagaattcctttcccagttgttaccctagcaaggctagggagggcatgaacacaaacataagaactggtcttctacactttctctgaatcatttaggtttaagatgtaagtgaacaattctttctttctgccaagaaacaaagttttggatgagcttttatatatggaacttactccaacaggactgagggaccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgtaaactggttcaaaaaaaaaaaaaaaaaaaaaaaaa

SEQ ID NO: 281 - DNA, 6572 bp, Homo sapiens
agctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcaggagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 282 - DNA, 7802 bp, Homo sapiens
agctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 283 - DNA, 3196 bp, Homo sapiens
ctctacccggttggcaggcggcctggcccagccccttctctaaggaagcgcatttcctgcctccctgggccggccgggctggatgagccgggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgtgagtaccccaggcccccacagtgagcatgccgggcccctccatccacccgggggagcccagtgaagcctctgagggattgaggggccctggccaggaccctgacctccgcccctgcccccgctcccgctcccaggttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaaccagtga

SEQ ID NO: 284 - DNA, 1910 bp, Homo sapiens
cttccccggctggggcggctggagagccgggagtcgctgggtgcgtggggctgcctcgccgcgtctcgccacgggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcgcaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtcttgaaaggggactataaaacaccagccaatctgaaaggatattttcaggtgaaccagaacagcacctcctcccacttaggaagctcgtgatttccagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctcatttgtttgtgccttactttactgaaaaaaaaaaaaaaaaaa

SEQ ID NO: 285 - DNA, 2515 bp, Homo sapiens
ggagccgcggcgtcccgtcgcagcgtgcgggagcaggtgggggtgcagcgcggtggcgcgcgggagccccgaggggcggaggcggctgctacacctagggcgtcgcggagcgccccgggcttggcgcgggcggagccgccctaagggccgcgcgtgtccccggcctcggccccgccccgtcccgtccaatgagagcccgcggccgaaggggctgtccgcacactaggcccgcagctcccttcagcgccgcagaccccctgacaccgcacccggtcctcaggcagcgcgccccagaccccgggttcggcacgccgtcgtcggcttccggacatcgcaacttgcgcccctctcggggatcctcctcccgggctctggaccccaggtgatcctaggtccccagccgccggcgaacaccatggccccccaggggggtgaggtaggagcagcctgagtacccccagaaggtgccccgtccacgcccctccgggctgcgcggcgggagtcttcggggagctatgctgagaccgggtggtgcggaggaagctgcgcagctcccgcttcggcgcgccagcgccccggtccctgtgccgtcgcccgcggcccccgacggctcccgggcttcggcccgcctaggtcttgcctgccttctgctcctgctgctgctgacgctgccggcccgcgtagacacgtcctggtggtacattggggcactgggggcacgagtgatctgtgacaatatccctggtttggtgagccggcagcggcagctgtgccagcgttacccagacatcatgcgttcagtgggcgagggtgcccgagaatggatccgagagtgtcagcaccaattccgccaccaccgctggaactgtaccaccctggaccgggaccacaccgtctttggccgtgtcatgctcagaagtagccgagaggcagcttttgtatatgccatctcatcagcaggggtagtccacgctattactcgcgcctgtagccagggtgaactgagtgtgtgcagctgtgacccctacacccgtggccgacaccatgaccagcgtggggactttgactggggtggctgcagtgacaacatccactacggtgtccgttttgccaaggccttcgtggatgccaaggagaagaggcttaaggatgcccgggccctcatgaacttacataataaccgctgtggtcgcacggctgtgcggcggtttctgaagctggagtgtaagtgccatggcgtgagtggttcctgtactctgcgcacctgctggcgtgcactctcagatttccgccgcacaggtgattacctgcggcgacgctatgatggggctgtgcaggtgatggccacccaagatggtgccaacttcaccgcagcccgccaaggctatcgccgtgccacccggactgatcttgtctactttgacaactctccagattactgtgtcttggacaaggctgcaggttccctaggcactgcaggccgtgtctgcagcaagacatcaaaaggaacagacggttgtgaaatcatgtgctgtggccgagggtacgacacaactcgagtcacccgtgttacccagtgtgagtgcaaattccactggtgctgtgctgtacggtgcaaggaatgcagaaatactgtggacgtccatacttgcaaagcccccaagaaggcagagtggctggaccaaacctgaacacacagatacctcactcatccctccaattcaagcctctcaactcaaaagcacaagatccttgcatgcacaccttcctccaccctccaccctgggctgctaccgcttctatttaaggatgtagagagtaatccatagggaccatggtgtcctggctggttccttagccctgggaaggagttgtcaggggatataagaaactgagcaagctccctgatttcccgctctggagatttgaagggagagtagaagagatagggggtctttagagtgaaatgagttgcactaaagtacgtagttgaggctccttttttctttcctttgcaccagcttcccgatacttcttggtgtgcaagaggaagggtacctgtagagagcttctttttgtttctacctggccaaagttagatgggacaaagatgaatggcatgtcccttctctgaagtccgtttgagcagaactacctggtaccccgaaagaaaatcttaggctaccacattctattattgagagcctgagatgttagccatagtggacaaggttccattcacatgctcatatgtttataaactgtgttttgtagaagaaaaagaatcataacaatacaaacacacattcattctctctttttctctctaccattctcaacctgtattggacagcactgcctcttttgcttacttgctgcctgttcaaactgaggtggaatgcagtggttcccatgcttaacaaatcattaaaacaccctagaacactcctaggatagattaatgtagtaaaaaaaaaaaaaaaaaaaaaaaaaaaaaaaaaaaaaaaaaaaaaaa

SEQ ID NO: 286 - DNA, 5305 bp, Homo sapiens
agcgagctcccggggaaaagcaacggtgtcctcctaagcctgaggccaccgcgaccgagccgagccaggctaagggaccagtgtctccctgccccccccccacctctaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaagtgagtggaa

SEQ ID NO: 287 - DNA, 5702 bp, Homo sapiens
tgctatccaccccagctggaatttagaccagacttacaggctttctgctccttccttcagtgaagaagagtctccagggtccctctagtgcaggtcaaagaagtccagtccagctgagttcagctccctagggcctccccagccagtctcctggaccaagagctggctttgcaagaaaacatcctactaaagccctgggaaaagagacaaatggtgaagaggagaatgaaaggttgcaggagggagctcctgttttagccctgccacctacctgggggccctctggctaccagtgtccttggaggggcttccttgctgcttctcccactaaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagagatggagaagctgctgctccctgctgtagacttagagcagtggtaccaggagctgatggccgggctggggactggccccgctgcagcctcccctcactcttctcccccgcctctgcccgccaaagcttcccgtcagctgcaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagaagaggtttttccgcttcactatggtgactgagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaagtgagtggaa

SEQ ID NO: 288 - DNA, 1293 bp, Homo sapiens
aaaagaacgaagtccagcaccaaaacgtgctacaacatggatgaacttcgatgactttgtgccacatgaaagaagaagccagccacaaaaggccatatattgtatgaaatgaaatgtccagaatgggcaaacccatagagacacaaaaatctccgccacctccctactctcggctgtctcctcgcgacgagtacaagccactggatctgtccgattccacattgtcttacactgaaacggaggctaccaactccctcatcactgctccgggtgaattctcagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactccccgacgctggacgcgcccggcggccgcgccctggtcgtgcgcaaggtgccccccggctactccatcaaggtgttcgacttcgagcgctcgggcctgcagcacgcgcccgagcccgacgccgccgacggcccctacgaccccaacagcgtccgcatcagcttcgccaagggctgggggccctgctactcccggcagttcatcacctcctgcccctgctggctggagatcctcctcaacaaccccagatagtggcggccccggcgggaggggcgggtgggaggccgcggccaccgccacctgccggcctcgagaggggccgatgcccagagacacagcccccacggacaaaaccccccagatatcatctacctagatttaatataaagttttatatattatatggaaatatatattatacttgtaattatggagtcatttttacaatgtaattatttatgtatggtgcaatgtgtgtatatggacaaaacaagaaagacgcactttggcttataattctttcaatacagatatattttctttctcttcctccttcctcttccttactttttatatatatatataaagaaaatgatacagcagagctaggtggaaaagcctgggtttggtgtatggtttttgagatattaatgcccagacaaaaagctaataccagtcactcgataataaagtattcgcattatagttttttttaaaaaaaaaa

SEQ ID NO: 289 - DNA, 8487 bp, Homo sapiens
ttgtcagtcccgcggagccagaggaggcgccggtcgctggcagctgagcggcggaacccttcgctggcgggagcgcggttcggggccgcagaggggacattgaataaacctgagtattgtgtgcctgtattttgactgcgacctatcagatgagatcaggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagagaatgaaacaagaaacaaatcagaaaatgaaaagaaccgcaatcaggaagacaacaaagtcaaagaccttaaccaagagattgagaaacttaagacacaaatcaaacactttgaatcgttggaagaagagcttaagaaaatgaagtccaaaaataacgaccttcaggataattacctaagtgaacaaaataaaaacaaattattagccagccaactggaggagataaagctacaaatcaagaaacagaaagagttagaaaatggagaggtagaaggggaagatgctttcctgtccagcaaaggcagacatgagaggactaagtttagaggccacggaagtgaagcttctgtgtccaagcacacagcgcgggaactgtctcctcagcataagcgggaacgactccggaacagggagtttgctctcaacaatgaaaactattctctgagcaacaggcaggtttcttctcccagtttcaccaacaggagggcagcaaaagcttctcacatgggggtgagtacagacagtgggactcaggagacaaagaaaactgaagaccggtttgtacccggctcctcccagagcgaagggaagaagtctagggagcagccctcagtgctgagtcgctaccccccggctgctcaggagcacagtaaagcgtggaaggggacttccaagccaggcaccgagagcggactgaagggaaaagtggagaagacaacacgaacgtttagtgacaccacccatggatctgttcccagtgacccattgggtagagctgacaaggcttctgacacctcctctgagactgtctttggcaagaggggacacgtgcttggcaacggaagtcaagtaactcaggctgcaaactctggctgttctaaggccattggagccctggcctcatctcgaagatcctcctcagaagggctctctaaaggcaaaaaggctgccaatggccttgaggctgataacagttgcccgaattccaaggctcctgttctatcgaagtatccttatagctgtagaagccaagagaacatccttcagggattttcaacctcacataaagaaggggttaatcaacctgcagcagttgtgatggaagacagcagtccgcatgaagccttgaggtgtcgagtcatcaaatccagtggcagagagaagccagactcagatgatgacttggacatagcatctcttgttactgccaagttggtaaatacaaccatcactccagagccagagcccaaaccacagcctaactctagagaaaaggctaaaacccgaggggcacctagaacctccctatttgagaatgataaagatgctggaatggagaatgaatctgtgaaatctgtcagagcctccaccaataccatggagctcccagataccaatggtgctggggtaaaaagccaaaggccctttagccccagagaggcgttgcggtctagagccatcatcaaacctgttattgttgataaggatgtgaaaaaaatcatgggaggatctggaacagagactacgttggagaaacagaaacccgtctccaaaccagggccaaacaaagtgacaagtagcattactatatatccatctgacagcagcagccccagagctgctccgggtgaggccctgagggagaggcacacatccactagcaatatccaggtggggctggcagagctcacatcagttagcaaccatgtcagctccccttttgagctctccattcacaaacatgacatcaccctgcagcttgcagaagcggagagaatggcagatgggcccctgaaggacaggccagaaacagtggtctctcggagcagcattataatcaagccatcggatcctgtggagaggaatagccatgcacctccagcggagacaatcaggtggaaaagccatagtgccccttcagaagtgggcttctcagatgccagacatgttactgtgcggaatgcctggaagagtaggcgagacttgaaatctttagaagaccccccaactcgaataggtaaaaacgtggaatctaccaatagcaatgcctacacccagaggtcttccacagacttctcagaactcgaacagcccaggtcctgcctttttgagcagggcactcgaagggtaggaccaagttcaggggatgcccctgagccctcctccagaaggacccaaagtagcctcactgtgtcagaggtgcttacccgtcggaatcgggtaggagacaccatcactgtcgcagcctggaaccactcagcaagcatggaggaagaaggggaagactgtacactcagtgtctacaggcaactgcacaactccctggatccgtctgaactgcctgggaagcaggggctgccagagtctgggcgagtacgggccgaggaacgattacggccaaccaggccctgtgctgaggagaactgagcccgctgggtgtctgttgtctgccctctgctcctgcttctcagctcttccaccgtcctgccccacgaaggatccaaggccagttaaccaggcaagacacaagccttggctggaaaactgtggtagagccgggctgtggctcaggtaatttttgccatttggccagagggaatcagagactacaagctggacagtcacccaggcccaaccttccccaatgcacgagtcctctctctctccttgtccctgtccaccaagtagttggaccattctggcccccaaacaagggaagataaagtccccagcacacagcaggagtcaaaaattcttctcggctccttggtgggttgtttctggatcctagggcagcctctgtctgtgtggttaatgttctggtttctcagtctcctcactatatccacttcactcctcatttgcccaatgggctcaagtaccccataagatttaccagccatcagctctatctagggggctttcatttctttccccttggagttcttttcttcagacttaaagcagaaaggggtctgtgctgcctctaaaggattatgagactaccctttaggttgaagtttgacctggctcctggcttaccagtctcctggaagcagagcatgcagatactcatgcggatacccattggaatgacatcatccctccccaaccccagctctctctgctcaccttccaaaggcacctggaggtgcaagcctcatgcatctcctttcctgagcaccagtaatgctgctggcatcgcctgctttctctccagtggctggagacttcaagctgacttcattgtttccaccttgggaaaatccctaggctaagctgggcctgacccagcatcctctgccttctaggaagtgcccagcaagagggaaagcagacccctttagtcactccacaagcaatagctccatgagaggcatggactgtgagactactccctcctgttcctccttctccatcccccatggaggaggcatcgcactttaccaagctgatgcattcctacagaagtgggccccggatttctgcaagtcgactatcatgatgacttcgctggaggaaaggtgatacgtacatacgcattgagggcctcagctttatatagttcaaaatgcagcaaacttttcagaaagccacgtaaataaattggttaggttccttataccagtcacatggggaagttgaaaagaattgtatattcttggcagtgctttttctttagcattctgtcaattcaaagaagggatcctctttcaaaggctacctttatgaagtagacactattgccctcagaatgagagaacattaaactaccagtctggtaagctggatttttttccccatggctttacttccttgctgtgtgaccttgggtgagtcattgtcttcttggagcctcagtttccctgtctgtaaaatgagttctttgaaatggatgatctctaagggcaccaaatctggtattctaaggttctcctgttttcaccatctataatagtatgggatgatttttgcttgtggaaggtatcatccgtgtgggttcttccctcctgccctcaattgtttttctgggccttgttttttagtttctgtatgttttaatctcatggggatgagctcagagaagctccgtgggcctgtttcccaatctgcaaagtgtgaagggattagatgggatggtctctgaggctctttgtggcatcagccttgcccagtgccacacagtatctcctggcgttctaggagtctaggtattatggaaagtacccaagtctgtgtatctcctgttcctgtgcatctcctatgaatttcctggcaagaggaagactcaagacttcctccagaggaatttgtcttctctgccttcactcagcatgggaaccagtgttcatcctgaccttgtctgtatcagatttggcagtgaggaggcttggggagcacctaccttactttcagggacaggaatctattgctcatacttctgcttcccagagttttgccaatctaaaggcattgtcatgtggcctgcctttcctgtccacatccccacctctgatgctcaagatgctatttccaagatctcttactgctgcttctcctggcttactggccagaaactagctcactcaaggctgccatccttcacttgcagcctccctgccattctccttcactggttggcaaccttgagagttcaaagaaaatcaacctctgtggtggtcaactaaaggtattaggaaactaagtctgtggctcttctctgctgatggaaacagaagggcgccaagccatgcctaaaaagatctcgccaataattcttgtctttgagtgttggagccctggattctggtgctatagctcctggtgccaaagtctggatctttccacatttcagcagcaccaacatctgctgctactcaaaatgtcctgttgaagagggacagctgtgatgcccttttgctggggctgccatcttgaaatctgagtgcaataggatttgcttgtaacagttatttcaggatattttgtttctttaatctgcacactttctagatagattttatttttaagtgtcctcagcattgcagaaaataacattgtaatagcaagtaaaggctggaggctgtttctctgggcttcaaatggctggcaaggctggctctcaaatcccaaagttgggaggcatgtttctgaaaagcaactgaggtgtgactgtttggacccaggcctcatcatcaggggtcctggaggaagcctccaagtagaggggagacctggtagttgaatagttgtttaatcaagccaaatagtcccactgcccccggtcaacaaacccacttttatgacagttttcttccgcagcttggctcttaaattttactggcaggtgtatggttgttggagggttcctagtgagttgggggacctggcaatagagctgcttggttggaggaagtgaagctggcttagtaccagcagctgatctcttccacgtgctgctgctttttttgccactctgatactaaaccagagaaagctgcaggtggataaagaagctgtggctgttttttgcttttgggtggcaatgagaaagagtcacagtgtgggttaaagggatctgcagtggggccaaggatgccaccccaccctcagctgtaggcaagcttgcacataaataacccccgtcagtggagtgttcgggatgcagggggcactatagtgttcttggacttgtcgtcctggggcagttttagttctttatatttagtgggtcagtgccaagtgctaccacttcccaataaaggaatggggacccagaggctgggtccctggctaccttgttatgaggttttgttatttctctgacaagattgctttggaaagagctgcttttagggattattttttgaataccccgagtggggagcagggttctcctcaaagcctcacaaccataggatcataggaaaggggccctattttcctgctgcttcccagctcagaacatatactgaatggaatgtatttttaagagaataaagtctatttttttgtattttaaagattgagagggctaagaaagtagccctcaaataaactgttattgcattataggcccctttgttgggggcagcctgttggtccacacctacttgctcaggcaggtgctctggtctctctcacccctgccccttagagtctaggtgcagcagctccaagcatgggaccaaggaggccagaacctgtcgctggaaaccagggcaaagcagtggctcagggctccttgggtgcatgtgtatcattggagctgcctgtctgcatgtatcctctggcgcgaatgctctctgttggctctgcagtacaatatgtaaccaataaagctccctcgtttccgtatactctgtgcgagtctgtgatgccagttttgtcaatgtcatccctgtgtatcatctgtcttctatgcgttggcgcagctctagtatatttatttatttcattgtgtaatacttaaaattgggtattttacctaaccaattactgatactgcaaggactggaaacattaactgccctgatcctggtgtgcagattctttccattactgccacgaattctaagactagggggggaaaagccttctccgttttcatcttccagtcagatcaccaatatatataatgatgtcccttaactcacagtaagaaagaataaaaccacatttaagggacattacttggatttgcagtaacagtgtttatcatctatctgtcagtcagtcaggagcccctgggaaggaaccagcatgtaacatgtttttatcatcttatatggcaaaagggactttgcagataaggatgctgggatgaggcagaacatcctagatgatccaggtgggccttaaatgtaatcacaggtagtatccttttaagagagagacaaaagatttgactacaggagaaggcaatgtgatgatggaagcagaaactggagttatgtgctctgaggatggaggaaggagccacgagccttcccacacctagaagctgaaaagagcaaggaaatgaactgatcctccctgctctgagagcctctgtaatgaatgcagccctgtgtacccattttagactttaagcttccagaactttcgaatagatttctgtttttttaagagccactaagtttgtggcaatctgttaaaccagctgttacctaagcccttgatcctatgtagtgcgcttcccaaaatgtacaccaccacctttagtagaattgggaagttttagcacatacccatggagggaatcaggaataaaggcagactggtctcccaaaggctcag

SEQ ID NO: 290 - DNA, 3831 bp, Homo sapiens
gtcagcttgggggtgccttcgtcgcgcagccttgcgtcggcccggcccggccaggccagcgggcagatgccccgagctgccgccgccgccgccgccgactcggccggtggcggtgtgggaggtgggcgaccagcccggggccgctgagtgtgacggacgcaactgggggcgccgggggctccgcacggaccatgtattttctgagcggctggcccaagaggctgctgtgccctctggggagcccggccgaggcgcctttccacgttcagtccgacccgcagagggctttcttcgccgtgctggccgcggcccgcctcagcatctggtacagccgacctagtgtgttaattgtaacctacaaggagcctgcaaaatcatctactcagtttggatcctacaagcaagctgaatggaggccagatagtaccatgatagctgtatcaacggcaaatggatacatcttgttttttcatattacatctacaagaggggacaagtacctttatgaaccagtgtatcccaaaggaagtccacaaatgaaggggacaccccattttaaggaagaacagtgtgctccagcattaaatttggagatgaggaaaatactggatttacaagcacccatcatgagtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacggttttcagctattgataagcttggacagaatattgctgtggttggcaagtttggttttgcacattactctttactcaccaaaaaatggaaactttttggaaacattacccaggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactggtaatgtagacttcatgtcacttgtacaaggagaattgtattttactccgtgtatttacacattttgctattagttgatattcaaggaattattttcattccaaacttaggaatggataaaagccaactttttgtacatgagttggaatgcccactgtttgaccaaagatgtaaataaagtagaacctatgtctctaaaaaaaaaaaaaaaaaaaa

SEQ ID NO: 291 - DNA, 6676 bp, Homo sapiens
gtcagcttgggggtgccttcgtcgcgcagccttgcgtcggcccggcccggccaggccagcgggcagatgccccgagctgccgccgccgccgccgccgactcggccggtggcggtgtgggaggtgggcgaccagcccggggccgctgagtgtgacggacgcaactgggggcgccgggggctccgcacggaccatgtattttctgagcggctggcccaagaggctgctgtgccctctggggagcccggccgaggcgcctttccacgttcagtccgacccgcagagggctttcttcgccgtgctggccgcggcccgcctcagcatctggtacagccgacctagtgtgttaattgtaacctacaaggagcctgcaaaatcatctactcagtttggatcctacaagcaagctgaatggaggccagatagtaccatgatagctgtatcaacggcaaatggatacatcttgttttttcatattacatctacaagaggggacaagtacctttatgaaccagtgtatcccaaaggaagtccacaaatgaaggggacaccccattttaaggaagaacagtgtgctccagcattaaatttggagatgaggaaaatactggatttacaagcacccatcatgagtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacgggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactgtgggagagcagctgttaaagtctcaatcagctgacccatttttgaaccttgagatggatgctggcatctccaacatccagcgaagtcagagctggctcagcaacattggccccacccatcatgagatagacacagcttcatcccatggaccacaaatgcaagatgccttcttgtcacctttatctaataaaggtgatgaatgcagtattggttcagccacagacttgactgaaagtagctccatggtggatggcgactggacaatggtggatgaaaatttctctacactcagtttaactcagtcagagctggagcacatttccatggagttggccagtaaagggcctcataaatcccaggtccagcttcggtatttgctacacattttcatggaggcagggtgcctagactggtgcatcgttataggcctgattcttagagaatcctcaataatcaatcagattttggttattacacagtcttcagaggtagatggagagatgttacagaacataaagacagggctccatgcagtggaccgatgggcctctacagactgtcctggatataagccatttttaaacatcattaagccacaactgcagaagctcagtgagataacagaagagcaggtccagccagatgccttccaaccaataactatgggtaagactccagaacagactagcccccgggcagaggagagcaggggctcctccagccatggaagcatcccccagggtgaagttggaagcagcaatatggtcagccggaaagaggaggacacagcccaagcagaggaggaagaaccttttcaggatgggacttacgactgttctgtgtcctaacagtgaggttccatcacaaaggggcagtattaattagcagcagcgtgcagctcagtacgttgtaacatagttggatgatttaacaggagaactcagttcagagactcttcggtaagtattagtagattttaactaattctttcttgtctaagaaatctttttgactccataaaaatgtgatataaagcatctttcataaaaaaattttaagctgcagtgaaaagtaaatattgtacagatgtacatgagaatattttggttttactcaaaggttggtagctcttaaaccacaggaattgttttgccccaggtgagcttactttttcactacttacatcttctcacatttcccggttctgcattatgtccagattgctttttaaaaaataaatgctaaggtgcttgctatagtctgtcaggtacttgagctacctgtttgctcccttggatacagctggactctttaatcagtcctcctgaatagattgctaccctggggcacaatatgtgccagtgtgatggaaacattctccttggctttactagccagtcaaatcccagtccagaattgatggaagctatttacctgtgagttaatgtgcttgttttagcaagcttgattcccattagaccaatgtgggcagaggtctgagggggttcttctcaattttgctgttagataccactaaactattttgtattaaagaacagtatctttttgtgaatactcttgtgtaaatatattcaaaggcactgttcatattttagggcttgtattataatttgcaaggttttaatgctggattctgcatgtctacacatacaaagacagggcttgctcctctgcaaaactgaggaagacaggtttattggcttggtcatgaagtaacagaaatggtcacactgatcatgaaatgcagcaagttttgtgcaaattaacatagtctcttatttattgcttttgtaaattgaataaagatggacttctatgtaaatagactgctgaatcctgtattaccacggctactaaaaattagtgtgtaaagaatgcattcttcattgtaaacttaaagtattttatgtacttctagaaatgacttaaatttgttttcatacattatgaaaacaactgcatactccttaattgctttaaacacccatccactgtatgtaattctaattaccttataacagtattaagacagcttgtttgtactgtgcaatttgaacaaggaatgcaatgttattttttacaaaaaacaaacttgtttatttttataataacgatgtatttgatgtggaccaaattcgtaccactatctaaaatagcctcttttctcatagtgcagttgtagtttagaaacaaaacttggtcctctctccttgctttttaaagtaaatggctagatttagttgtcttagccaggtttcctttgaagagaaactcaaaaccattttgaaactgcttagttcagaatacatcgaagtatttaaaattactgagttgggtaatttactatcatttactttttacattacaagtgcaataatatttcacaaaatgaaactcccgaatgggtggagtatgtgattattggtacctggtccttctggtgctatttttatttaagtctttgtttcaaaccacctttccctgaatcttaaagataatgttttgcatgtgagtacatgcagcccagcaagaaactaaactgaactctcttctcctatcctagtccattaaggagaagaaccagcattgcttttgtgtttggtgtgaatattcagtcaataaaaatgatttaccattataaagagctgtgatcttttcaagtatctgaaataaaacactgtgctgctgagttcatctcaaacattcttgaaagcagggcaccagtataagttaactgtattcctgtgggttaggccgtgaatgaatcatttcttttatacaatattcttttacaactaatagagataggaggcccccaggcaagaagtttggcaggtttacagaaaatttggtaatttatttgttatataccttaatttttaaaaacccatttttattgtggtgtttggttcacatatcaactgtttaagccataattttagccaatgaatttaaatattcagtataactatttgaggtttactagatgcatttattaataaattatttgctgaaaccaaaacaagtcattgggggtgtgggaataaaatcaacctttgcttgtaattaaagttgctgctatttctgtaatgtgtatttttctccccttggtaaagggcaataaaaccattacacaaaaaaaaaaaaaaaa

SEQ ID NO: 292 - DNA, 8059 bp, Homo sapiens
aaaagggcggtggggcggggggcggggcagggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatgtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaatacttgtttctctctctgcgtgttgtattgttggtagtcattatatgttggtgatacatctgcacacctcactgtttcacgtatctgtttttttctctatgttgtgtaaaaagatacagtcgattccacttaagtgaatatctgatttggggaagaggaaactgcacagcagccacctttgatttatgtacaaccgcccacttgaactcctgcttccaagatttatacacttttttcctacagttcacctcagtaactgcctttggggttggatttgccaaggtgttttacggtcttttgaccacacaggttaatttccccttctctcccctccctcatgagtctatccacgcagttcttaacatacattccaaactgctgcggggtttcctctccacacccacgaggccaaacccgcatcattacagtccaactcttcttagacactaatcactttctaaaagaagtgagttctccagggaagaaaaatcaacttagccagtgaaaagggttaaacttaagtctattatttgttgccctcaatcaaaagatatgtatagaaaagtcatttaaattatttatttctacaagctaattgaatccaggagcagctttaattattaacactaacggaagagaaaagaagtatttccaagggctcaaatggaagctgtactcagtccggtggaggcagggggaggtaaagtttctcacactcaagtcgtcttcatagtttactgtccttttccaaacaaaagctaataacgccatacgcatccacacactccctcctggatgaacctaagtctcgtccccactgtcaccccaaggccagttatcaaaaactgttccttctctgccctcaaagactgaagccgcaggccctgttctgcctctgctcaggaatctgattgctcttaaagtgctcttacaagattccgtcgatgtttgctccctctgtcttatctctccttccagtattttcagacgcacaagctctgactcaggccacccagcacctggcagccttcctctgcgtgccagtgaaatctctcccagtaggtgctcaggctcttcaccctctcgttgcagcagcccctctggcccgagattgtattttctagtctgctcaagaacagaggggcctggcgaggtggaggaagggaggctccctccccggggctggccgcctcagtgatggtgatgccaccagctccagcctgcacggatggagctcacttcctaccatcacttctgctttcagtctcctcatagccttcggcagtctcctctgaaaacacactgcctacgttagtgggaaaggatggctaagggtgtgatttctttttattagggaggtgggagggggatgttgggaggcatggggggtgattaaattatcatttccaaggtgcaagtgtttatttttcaaatctataagtacatagttccaccattttggcacaagacaaaatactcatgctaagcaaaggaagagaaagacaaagccagtttttgttgcttttctaaagcaacaaataattctccaaagaaggggatgaaaatgctagttcctttaagcacttactgactgtaaagttggtccctgcttaaattcatacccatagttttgagtcggtatgacaccactgcagtgtgagcaaggtgaatccgtgtgccatgcatggaccaccttgggataccgcagcaccatcaacatccgccttgctgatggaagccacacacgctgcccagcccacagcagtcgcacgcagccgatgggctcggactcttagctggcaggctaggacacacagtgaacattaatgtactgtgaatcgttcctgataagtgaataaaacattgtgaccaaacaatcagcttattcacttatcaggaatcgactgttctgctaatttgctgttgttgtttttcatctctgttgtagttcactatttttgctgtgttctgttttctcctctcatgcttgggcaaatcactgggaatattatcttcatgtgaccatgaaacgtttctattgagtgaaaatgatatcttaacaaaatctatgcacttgctatcaggaacacaatactggatgtgtcttatatatattgaactatatagtactcgatttcttaaataaagcttaagaaaggactctgttgtgtgtaaagttaatgtgattatttttcaaagcagtgtttctaaggggtatttttgttcttttaagtcttgagtgatacaggatatttttcattaaaattatatcactggctttatgacttaatattcaataaattgactttggaaacaaaaaaaaaaaaaaaa

SEQ ID NO: 293 - DNA, 8053 bp, Homo sapiens
aaaagggcggtggggcggggggcggggcagggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatgtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcaggtaccatcaacagtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaatacttgtttctctctctgcgtgttgtattgttggtagtcattatatgttggtgatacatctgcacacctcactgtttcacgtatctgtttttttctctatgttgtgtaaaaagatacagtcgattccacttaagtgaatatctgatttggggaagaggaaactgcacagcagccacctttgatttatgtacaaccgcccacttgaactcctgcttccaagatttatacacttttttcctacagttcacctcagtaactgcctttggggttggatttgccaaggtgttttacggtcttttgaccacacaggttaatttccccttctctcccctccctcatgagtctatccacgcagttcttaacatacattccaaactgctgcggggtttcctctccacacccacgaggccaaacccgcatcattacagtccaactcttcttagacactaatcactttctaaaagaagtgagttctccagggaagaaaaatcaacttagccagtgaaaagggttaaacttaagtctattatttgttgccctcaatcaaaagatatgtatagaaaagtcatttaaattatttatttctacaagctaattgaatccaggagcagctttaattattaacactaacggaagagaaaagaagtatttccaagggctcaaatggaagctgtactcagtccggtggaggcagggggaggtaaagtttctcacactcaagtcgtcttcatagtttactgtccttttccaaacaaaagctaataacgccatacgcatccacacactccctcctggatgaacctaagtctcgtccccactgtcaccccaaggccagttatcaaaaactgttccttctctgccctcaaagactgaagccgcaggccctgttctgcctctgctcaggaatctgattgctcttaaagtgctcttacaagattccgtcgatgtttgctccctctgtcttatctctccttccagtattttcagacgcacaagctctgactcaggccacccagcacctggcagccttcctctgcgtgccagtgaaatctctcccagtaggtgctcaggctcttcaccctctcgttgcagcagcccctctggcccgagattgtattttctagtctgctcaagaacagaggggcctggcgaggtggaggaagggaggctccctccccggggctggccgcctcagtgatggtgatgccaccagctccagcctgcacggatggagctcacttcctaccatcacttctgctttcagtctcctcatagccttcggcagtctcctctgaaaacacactgcctacgttagtgggaaaggatggctaagggtgtgatttctttttattagggaggtgggagggggatgttgggaggcatggggggtgattaaattatcatttccaaggtgcaagtgtttatttttcaaatctataagtacatagttccaccattttggcacaagacaaaatactcatgctaagcaaaggaagagaaagacaaagccagtttttgttgcttttctaaagcaacaaataattctccaaagaaggggatgaaaatgctagttcctttaagcacttactgactgtaaagttggtccctgcttaaattcatacccatagttttgagtcggtatgacaccactgcagtgtgagcaaggtgaatccgtgtgccatgcatggaccaccttgggataccgcagcaccatcaacatccgccttgctgatggaagccacacacgctgcccagcccacagcagtcgcacgcagccgatgggctcggactcttagctggcaggctaggacacacagtgaacattaatgtactgtgaatcgttcctgataagtgaataaaacattgtgaccaaacaatcagcttattcacttatcaggaatcgactgttctgctaatttgctgttgttgtttttcatctctgttgtagttcactatttttgctgtgttctgttttctcctctcatgcttgggcaaatcactgggaatattatcttcatgtgaccatgaaacgtttctattgagtgaaaatgatatcttaacaaaatctatgcacttgctatcaggaacacaatactggatgtgtcttatatatattgaactatatagtactcgatttcttaaataaagcttaagaaaggactctgttgtgtgtaaagttaatgtgattatttttcaaagcagtgtttctaaggggtatttttgttcttttaagtcttgagtgatacaggatatttttcattaaaattatatcactggctttatgacttaatattcaataaattgactttggaaacaaaaaaaaaaaaaaaa

SEQ ID NO: 294 - DNA, 8005 bp, Homo sapiens
ggggattggcggagcgcgaggagagaatgtgacaagtgccggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaattaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaatacttgtttctctctctgcgtgttgtattgttggtagtcattatatgttggtgatacatctgcacacctcactgtttcacgtatctgtttttttctctatgttgtgtaaaaagatacagtcgattccacttaagtgaatatctgatttggggaagaggaaactgcacagcagccacctttgatttatgtacaaccgcccacttgaactcctgcttccaagatttatacacttttttcctacagttcacctcagtaactgcctttggggttggatttgccaaggtgttttacggtcttttgaccacacaggttaatttccccttctctcccctccctcatgagtctatccacgcagttcttaacatacattccaaactgctgcggggtttcctctccacacccacgaggccaaacccgcatcattacagtccaactcttcttagacactaatcactttctaaaagaagtgagttctccagggaagaaaaatcaacttagccagtgaaaagggttaaacttaagtctattatttgttgccctcaatcaaaagatatgtatagaaaagtcatttaaattatttatttctacaagctaattgaatccaggagcagctttaattattaacactaacggaagagaaaagaagtatttccaagggctcaaatggaagctgtactcagtccggtggaggcagggggaggtaaagtttctcacactcaagtcgtcttcatagtttactgtccttttccaaacaaaagctaataacgccatacgcatccacacactccctcctggatgaacctaagtctcgtccccactgtcaccccaaggccagttatcaaaaactgttccttctctgccctcaaagactgaagccgcaggccctgttctgcctctgctcaggaatctgattgctcttaaagtgctcttacaagattccgtcgatgtttgctccctctgtcttatctctccttccagtattttcagacgcacaagctctgactcaggccacccagcacctggcagccttcctctgcgtgccagtgaaatctctcccagtaggtgctcaggctcttcaccctctcgttgcagcagcccctctggcccgagattgtattttctagtctgctcaagaacagaggggcctggcgaggtggaggaagggaggctccctccccggggctggccgcctcagtgatggtgatgccaccagctccagcctgcacggatggagctcacttcctaccatcacttctgctttcagtctcctcatagccttcggcagtctcctctgaaaacacactgcctacgttagtgggaaaggatggctaagggtgtgatttctttttattagggaggtgggagggggatgttgggaggcatggggggtgattaaattatcatttccaaggtgcaagtgtttatttttcaaatctataagtacatagttccaccattttggcacaagacaaaatactcatgctaagcaaaggaagagaaagacaaagccagtttttgttgcttttctaaagcaacaaataattctccaaagaaggggatgaaaatgctagttcctttaagcacttactgactgtaaagttggtccctgcttaaattcatacccatagttttgagtcggtatgacaccactgcagtgtgagcaaggtgaatccgtgtgccatgcatggaccaccttgggataccgcagcaccatcaacatccgccttgctgatggaagccacacacgctgcccagcccacagcagtcgcacgcagccgatgggctcggactcttagctggcaggctaggacacacagtgaacattaatgtactgtgaatcgttcctgataagtgaataaaacattgtgaccaaacaatcagcttattcacttatcaggaatcgactgttctgctaatttgctgttgttgtttttcatctctgttgtagttcactatttttgctgtgttctgttttctcctctcatgcttgggcaaatcactgggaatattatcttcatgtgaccatgaaacgtttctattgagtgaaaatgatatcttaacaaaatctatgcacttgctatcaggaacacaatactggatgtgtcttatatatattgaactatatagtactcgatttcttaaataaagcttaagaaaggactctgttgtgtgtaaagttaatgtgattatttttcaaagcagtgtttctaaggggtatttttgttcttttaagtcttgagtgatacaggatatttttcattaaaattatatcactggctttatgacttaatattcaataaattgactttggaaacaaaaaaaaaaaaaaaa

SEQ ID NO: 295 - DNA, 3046 bp, Homo sapiens
gagccgagaggggcgaatccggcttcgctccgcgccgccgggaggagctgtctgcagccccctcctcccgccctcgcctctccctcctccttctcccgccctcctcgccgatccgggcggtgctggcagccggagcggcggcgggcgggccgagcagccggggcagccgcgcgtgggcatccacgggcgccgagcctccgtccgtgtctctatccctcccgggcctttgtcagcgcgcccgctgggagcggggccgagagcgccggttccagtcagacagccccgcaggtcagcggccgggccgagggcgccagagggggccatgtcgtaccagggcaagaagagcatcccgcacatcacgagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactgacctgactagggcactttcaaaaaaaaaa

SEQ ID NO: 296 - DNA, 1769 bp, Homo sapiens
cggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccactccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctgaaaaaaaaaaaaaaaaaa

SEQ ID NO: 297 - DNA, 2079 bp, Homo sapiens
cttggtgtatatagtaaaggccgggcgccgcacgcagacacacactcgccaggacacaggcgcacacacgctcacgcacaaccagcagcggcggcggcgacagcgactcggtgacagcggcgacggcggctcccaccgcggcgcacccccttcaggcggccggcggcgaggccagaccggagagttccagcacactcgaccaccccgcggcttcctggaggcggcggccgcgattgcgaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccggtgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcactaaaaa

SEQ ID NO: 298 - DNA, 2426 bp, Homo sapiens
cttggtgtatatagtaaaggccgggcgccgcacgcagacacacactcgccaggacacaggcgcacacacgctcacgcacaaccagcagcggcggcggcgacagcgactcggtgacagcggcgacggcggctcccaccgcggcgcacccccttcaggcggccggcggcgaggccagaccggagagttccagcacactcgaccaccccgcggcttcctggaggcggcggccgcgattgcgagcaggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccggtgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcactaaaaa

SEQ ID NO: 299 - DNA, 2229 bp, Homo sapiens
cttggtgtatatagtaaaggccgggcgccgcacgcagacacacactcgccaggacacaggcgcacacacgctcacgcacaaccagcagcggcggcggcgacagcgactcggtgacagcggcgacggcggctcccaccgcggcgcacccccttcaggcggccggcggcgaggccagaccggagagttccagcacactcgaccaccccgcggcttcctggaggcggcggccgcgattgcgaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccggtgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcactaaaaa

SEQ ID NO: 300 - DNA, 14152 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagttttttttttttttttgtgggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggacccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctactaactctggactttgtctgtttattaacctttatatgtttaattaaaataaacaaataaagacaaaagaatgtaaagtcttgagttactggactaaccctgaagaacgtgaccacagataacatagtgtgacttgtttttatgttgtttgtcagctgacagttttgcacactactgttaaaatggctttggttattctggtcttttagcttgggggccggggcgggtgtgggtgtaggtgcagtagagatgggaacaaagtagcctttgtttgaggcattcttctcttgccacttgcctttcagcatctgcattactaattccacaccttatttttccttctccaaaataatcactgtctgctcacagcatcgagtaaaaagatacattgtcatggtatatacctggagaaaccagtttgattctttgttgaaccatttcttttaatttctgtaaataagtaattttatggtcacattgtaaagcagagaaactgttgatattttacctttatttagatttttgttttaacttgacctttttcctttggaaagcgttgaacttgtttagctaactactcctattaggggagcttaacttgggtaaagtcaaaggcccactggctgtttctcatggtggcctgaagccccgctgctttccagtgaggaaaagaaccctcagcacgttactgagctttcctcaggtatttttttctctgtcacctactttacaaatacagtcagactaaaacattaaacaagaagtttaagggggaataacattgggatttgaaaagttgtatgtgattaatttcttgcatgcaaatcaatttaagatttcttaaatatcttcatgcttttcttggctggaacttgggtaaattaacctgtaattatgaattatttagtttaactcaaggtgcatttttatttcacagattgatacttgcttttttctgtgaaacagttctcctagataccaaaatcctcaggatgaatttttgcatttgtaaataacaatttatctttgtaaattacattttatttatttagagttctaaaattgagggctgaaatgaatgacatgtaatagaagacaaaactgtaccaatacgctgttaaccaatcagactgtccaggtattctcatttcataaatatgtatacacacatataaatacacagagtagtgttagctgatgtgagtgataacagcgaatcaccattgagatggtcatttggatcatgtaaacaaaccgtgtcatgtctctgatgggagcggtgggtagtgtactgttaggtggacaggtcttttaacatgctactatttgtaaaagtttccgttgccataacagttcatgtagtagtctgtgaaaattcgaagctgtctgtcaagctgctaatatacaagttgtcatggtaccatgtaacttaaattgatgaatttctatgcaatttactattctctgaagcctatgaatgcagcctcatctcattttcagttaagggtactttatgtataattatgtcattgctgccttttatgtaggaaatgtaaaaaagttttaaaaggcgaaaataacattacagatttcatttttatacaggttacaatattaaacatgaaactaccaaattccaagaatagtaaaattctagagtcagttgattgattgaaactatttgacaaaacagttgaaagctgagctttcagtcaagaagttggtgaaattaatgtccttaaacttttcctttaggcaaaatgtcagggaaaacttaacatgaaagtagttactcccatacgcaccagtgcagtagctccaggtgtaagaggtcacgaaggcaccctgcccataaaaccaggatgtgcatacgtacacacaatcggtgtctggttatggttttctaaacactacataaggatctgaattttttagtgtgccaaaagcaaacgataggtttaaatgaaattgctcactaccaaatcaagactcttcatatatatacgtgtgtgtatatatatatgtcataacactttcacgtgtgacagcctaaggtttctttagttttaggatggggtggggtgggagtggttttgcatgtttgaccaggatgtgatgcctgtctttattccttgataagaagtagctgttacagcatttcaagcaaattattttaggtagaatagaacttactgccaaatgattatttatttagcaaaaattattctccaacttttcgaattcacaatttttctaagtgcatagagtagttttttacattgtcacgaattccttaatacctttatttaaaatggaaaaaatatggacaatattttagaaatatgtgctacacatctaattttatctgtagtttaagtgatctaaattgagatgcctttgatatgaagagatttaccaacattatatgcactcgtgccttcaatgtggaatcaaactggttaacctcagcacagtcctctcgtttctgtgtttctgctgcactaattgccagggggtgggggagaaggcgaatgaattaattcatagtagaaggaggcgataggtgcagcaaagggcagccacagtgttgattccacattataatgttgttgcctcttcttggcaaaagacaccacattgtgggaagatctcagcttccagggtaaaagttaatttataacttaaaagtgctattaagtttttattaccaaatatatcttttatggtttatattgtagtggtatgtatgaaacatttaaaattttactgtggaaattgtgtatatatatatatatagtcgaaataggtgttcacaggtcacatgtgaacggagaactgcatgaccgtacatgaaatgcaataaaccaactggaaaaagtgcatgtgcttcatcctctcaagccaactgcagctggaaagtgctgcttatcctccacccccagaaaatgcatgtatcaatatgagaataaagaacgcacactttcaattttattgaggctttcaacactatttaaaagaaaatgtaagaatttgacattctggagttattataacattagaaaatgagcataacattcactctgattttagccattaagggagattagtaaacagactgctacagtgttccatagttggactgtgcatccaaaacatttttttatctttaataaatggtacagtttttatgtagttttcgaatgtaagaagaaaggaatgctgaccaaaacttgatttcatcagcttcatgaaaaggactagtgtcattaacctgttgaacagaattggtttattaaaaaaatcatttccagtagtgtgaaacctttacgagtctttaacatctaaatgttatgactccttgtaccttaagttttccagtctttcttatttatatcatctccaagtacctctggctcctttcctcttgctcaccggaaccttagttttcctcaacagaatgctttgttaaagtagcccacagttgcaggatccatagcaccgtcgtgcagactagcagcccaaaggtgtgtttggtttggcttatacggtgttttgctttttaaactacttgccataatttaaaagtggcaacactagacttaaaaaaaaaaaagtctgattgcccatattagattttttttttaattcttcacaaaatctgctcttcctgaaagatcaaagtgtctagaaagcccaaacatgtattcttaacatagtaggcaccagctgaaactgagtaattaaacggtcccctgaagccaagtattccctggttagtcgccaccccaccactccttcctgtctctagtgtcacacttgggctgttgattttcttactcttctcttgctttaatccttccccccggctctctggctcctgtggatatctgtgcttgtttcctggtccaggatggtgatctgactttcaaaccagcttctcaaaaggggtgacataaaatcagttttgatgtttttcctcctgaaaaatcagatgaatattttagtcactgttactcatgcacattgtgttcttatgtttacagaagtgcttaagtgaatggaagcactagacatttggatttccttcctaacgtaatttttaatgattaccccttttatacagtaatttgtggtctttagaaagcagttaaactaattgaccatctaatagttgtactatacatatgtctaaaataatagtcatggtaagtttggcatcatatcttccccaaaaaatgtttattaaaattagattattccagtttaatgctattttgtgaactgtataccctctgaaagcgcttatttttacatgctacacaacagttccaattttaaggagtgtctcctaaaattgggatgaaaatctactgtagtctgttttaaagtatgctatactatgttcattggttacttaactggatattaatataaaggttattacaagaaaaatgatgaagagcaaaaggagaagaaaatatttgcaagtgaatccacaattcttgcagaactatttgagttgatactaaagattttatgttcactcctttaccttagaactgtcaagcttgggaatgaggaaagtgccttggctgtgcttgaaacctgaattttagtgcttcccttattacattcattgttttcaatgattgatttataaaattaagacatactggtagtacaagttgaaagttggtttgaatacattttaattaaatgataatatgttaatatgcttttgttcattgctttctcactgaggtaaaacagcattaaaaagttgtccagaatttaaactgaaaaaaaaaaaaaaaaa

SEQ ID NO: 301 - DNA, 15431 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagttttttttttttttttgtgggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggacccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctactaactctggactttgtctgtttattaacctttatatgtttaattaaaataaacaaataaagacaaaagaatgtaaagtcttgagttactggactaaccctgaagaacgtgaccacagataacatagtgtgacttgtttttatgttgtttgtcagctgacagttttgcacactactgttaaaatggctttggttattctggtcttttagcttgggggccggggcgggtgtgggtgtaggtgcagtagagatgggaacaaagtagcctttgtttgaggcattcttctcttgccacttgcctttcagcatctgcattactaattccacaccttatttttccttctccaaaataatcactgtctgctcacagcatcgagtaaaaagatacattgtcatggtatatacctggagaaaccagtttgattctttgttgaaccatttcttttaatttctgtaaataagtaattttatggtcacattgtaaagcagagaaactgttgatattttacctttatttagatttttgttttaacttgacctttttcctttggaaagcgttgaacttgtttagctaactactcctattaggggagcttaacttgggtaaagtcaaaggcccactggctgtttctcatggtggcctgaagccccgctgctttccagtgaggaaaagaaccctcagcacgttactgagctttcctcaggtatttttttctctgtcacctactttacaaatacagtcagactaaaacattaaacaagaagtttaagggggaataacattgggatttgaaaagttgtatgtgattaatttcttgcatgcaaatcaatttaagatttcttaaatatcttcatgcttttcttggctggaacttgggtaaattaacctgtaattatgaattatttagtttaactcaaggtgcatttttatttcacagattgatacttgcttttttctgtgaaacagttctcctagataccaaaatcctcaggatgaatttttgcatttgtaaataacaatttatctttgtaaattacattttatttatttagagttctaaaattgagggctgaaatgaatgacatgtaatagaagacaaaactgtaccaatacgctgttaaccaatcagactgtccaggtattctcatttcataaatatgtatacacacatataaatacacagagtagtgttagctgatgtgagtgataacagcgaatcaccattgagatggtcatttggatcatgtaaacaaaccgtgtcatgtctctgatgggagcggtgggtagtgtactgttaggtggacaggtcttttaacatgctactatttgtaaaagtttccgttgccataacagttcatgtagtagtctgtgaaaattcgaagctgtctgtcaagctgctaatatacaagttgtcatggtaccatgtaacttaaattgatgaatttctatgcaatttactattctctgaagcctatgaatgcagcctcatctcattttcagttaagggtactttatgtataattatgtcattgctgccttttatgtaggaaatgtaaaaaagttttaaaaggcgaaaataacattacagatttcatttttatacaggttacaatattaaacatgaaactaccaaattccaagaatagtaaaattctagagtcagttgattgattgaaactatttgacaaaacagttgaaagctgagctttcagtcaagaagttggtgaaattaatgtccttaaacttttcctttaggcaaaatgtcagggaaaacttaacatgaaagtagttactcccatacgcaccagtgcagtagctccaggtgtaagaggtcacgaaggcaccctgcccataaaaccaggatgtgcatacgtacacacaatcggtgtctggttatggttttctaaacactacataaggatctgaattttttagtgtgccaaaagcaaacgataggtttaaatgaaattgctcactaccaaatcaagactcttcatatatatacgtgtgtgtatatatatatgtcataacactttcacgtgtgacagcctaaggtttctttagttttaggatggggtggggtgggagtggttttgcatgtttgaccaggatgtgatgcctgtctttattccttgataagaagtagctgttacagcatttcaagcaaattattttaggtagaatagaacttactgccaaatgattatttatttagcaaaaattattctccaacttttcgaattcacaatttttctaagtgcatagagtagttttttacattgtcacgaattccttaatacctttatttaaaatggaaaaaatatggacaatattttagaaatatgtgctacacatctaattttatctgtagtttaagtgatctaaattgagatgcctttgatatgaagagatttaccaacattatatgcactcgtgccttcaatgtggaatcaaactggttaacctcagcacagtcctctcgtttctgtgtttctgctgcactaattgccagggggtgggggagaaggcgaatgaattaattcatagtagaaggaggcgataggtgcagcaaagggcagccacagtgttgattccacattataatgttgttgcctcttcttggcaaaagacaccacattgtgggaagatctcagcttccagggtaaaagttaatttataacttaaaagtgctattaagtttttattaccaaatatatcttttatggtttatattgtagtggtatgtatgaaacatttaaaattttactgtggaaattgtgtatatatatatatatagtcgaaataggtgttcacaggtcacatgtgaacggagaactgcatgaccgtacatgaaatgcaataaaccaactggaaaaagtgcatgtgcttcatcctctcaagccaactgcagctggaaagtgctgcttatcctccacccccagaaaatgcatgtatcaatatgagaataaagaacgcacactttcaattttattgaggctttcaacactatttaaaagaaaatgtaagaatttgacattctggagttattataacattagaaaatgagcataacattcactctgattttagccattaagggagattagtaaacagactgctacagtgttccatagttggactgtgcatccaaaacatttttttatctttaataaatggtacagtttttatgtagttttcgaatgtaagaagaaaggaatgctgaccaaaacttgatttcatcagcttcatgaaaaggactagtgtcattaacctgttgaacagaattggtttattaaaaaaatcatttccagtagtgtgaaacctttacgagtctttaacatctaaatgttatgactccttgtaccttaagttttccagtctttcttatttatatcatctccaagtacctctggctcctttcctcttgctcaccggaaccttagttttcctcaacagaatgctttgttaaagtagcccacagttgcaggatccatagcaccgtcgtgcagactagcagcccaaaggtgtgtttggtttggcttatacggtgttttgctttttaaactacttgccataatttaaaagtggcaacactagacttaaaaaaaaaaaagtctgattgcccatattagattttttttttaattcttcacaaaatctgctcttcctgaaagatcaaagtgtctagaaagcccaaacatgtattcttaacatagtaggcaccagctgaaactgagtaattaaacggtcccctgaagccaagtattccctggttagtcgccaccccaccactccttcctgtctctagtgtcacacttgggctgttgattttcttactcttctcttgctttaatccttccccccggctctctggctcctgtggatatctgtgcttgtttcctggtccaggatggtgatctgactttcaaaccagcttctcaaaaggggtgacataaaatcagttttgatgtttttcctcctgaaaaatcagatgaatattttagtcactgttactcatgcacattgtgttcttatgtttacagaagtgcttaagtgaatggaagcactagacatttggatttccttcctaacgtaatttttaatgattaccccttttatacagtaatttgtggtctttagaaagcagttaaactaattgaccatctaatagttgtactatacatatgtctaaaataatagtcatggtaagtttggcatcatatcttccccaaaaaatgtttattaaaattagattattccagtttaatgctattttgtgaactgtataccctctgaaagcgcttatttttacatgctacacaacagttccaattttaaggagtgtctcctaaaattgggatgaaaatctactgtagtctgttttaaagtatgctatactatgttcattggttacttaactggatattaatataaaggttattacaagaaaaatgatgaagagcaaaaggagaagaaaatatttgcaagtgaatccacaattcttgcagaactatttgagttgatactaaagattttatgttcactcctttaccttagaactgtcaagcttgggaatgaggaaagtgccttggctgtgcttgaaacctgaattttagtgcttcccttattacattcattgttttcaatgattgatttataaaattaagacatactggtagtacaagttgaaagttggtttgaatacattttaattaaatgataatatgttaatatgcttttgttcattgctttctcactgaggtaaaacagcattaaaaagttgtccagaatttaaactgaaaaaaaaaaaaaaaaa

SEQ ID NO: 302 - DNA, 16378 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtaagttcttctccccatggggttaacaacattctctttataaatatttttgctccctcagattttgaaatgattttatcagttttagagaggcaagacaagtttgcattagggaagaccgaaaactaaattttgttttatttcagcctctcataagggttcccctttgaaataattgcaccttaaatttattcagatccactttggtaactgaggttcagtttggttgggtaaatctgttgtgtacatttcaacaaatacttttacatttgacattactgaggtcattctgagttttaggtcccaccccattggcccgtcacctccatcagctccacttctcaaactttatttgagatttattttatctcacaggtttgtgtaattgttggaaaatttttaaacttctaagtgaaagtagtctgagcgctttataaaattcatattattgtgtgtgttttgtaatatttgcgatcacttaaaatatcagataaatacagtcatgcatcgcttaacaacggggatacagtctaagaattgccttgtctggcagtttcatcatttggtgtacatcatagagtgtacttacacagacatagatgatatcgtttactacacacctaggctgtgtggtatagccattataatcttatgggaccacatagtataagtggtccgttgttgaccaaaatgttgttatgcaggcatgactgtagttgtattcttaagatttttcagttcttgtgttttggagtcctagtcatattaaacatgagagatactcttaatttcagtagtacagtatggaatagttaaataaatagcaaatcactgaattcagaatctcacttaaggcagaaattaaaatcataatataaacgcttggttttacatgaacaaaaagtggtgtgctcgaaaaagacattactgatgccttttttttatagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagttttttttttttttttgtgggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggacccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctactaactctggactttgtctgtttattaacctttatatgtttaattaaaataaacaaataaagacaaaagaatgtaaagtcttgagttactggactaaccctgaagaacgtgaccacagataacatagtgtgacttgtttttatgttgtttgtcagctgacagttttgcacactactgttaaaatggctttggttattctggtcttttagcttgggggccggggcgggtgtgggtgtaggtgcagtagagatgggaacaaagtagcctttgtttgaggcattcttctcttgccacttgcctttcagcatctgcattactaattccacaccttatttttccttctccaaaataatcactgtctgctcacagcatcgagtaaaaagatacattgtcatggtatatacctggagaaaccagtttgattctttgttgaaccatttcttttaatttctgtaaataagtaattttatggtcacattgtaaagcagagaaactgttgatattttacctttatttagatttttgttttaacttgacctttttcctttggaaagcgttgaacttgtttagctaactactcctattaggggagcttaacttgggtaaagtcaaaggcccactggctgtttctcatggtggcctgaagccccgctgctttccagtgaggaaaagaaccctcagcacgttactgagctttcctcaggtatttttttctctgtcacctactttacaaatacagtcagactaaaacattaaacaagaagtttaagggggaataacattgggatttgaaaagttgtatgtgattaatttcttgcatgcaaatcaatttaagatttcttaaatatcttcatgcttttcttggctggaacttgggtaaattaacctgtaattatgaattatttagtttaactcaaggtgcatttttatttcacagattgatacttgcttttttctgtgaaacagttctcctagataccaaaatcctcaggatgaatttttgcatttgtaaataacaatttatctttgtaaattacattttatttatttagagttctaaaattgagggctgaaatgaatgacatgtaatagaagacaaaactgtaccaatacgctgttaaccaatcagactgtccaggtattctcatttcataaatatgtatacacacatataaatacacagagtagtgttagctgatgtgagtgataacagcgaatcaccattgagatggtcatttggatcatgtaaacaaaccgtgtcatgtctctgatgggagcggtgggtagtgtactgttaggtggacaggtcttttaacatgctactatttgtaaaagtttccgttgccataacagttcatgtagtagtctgtgaaaattcgaagctgtctgtcaagctgctaatatacaagttgtcatggtaccatgtaacttaaattgatgaatttctatgcaatttactattctctgaagcctatgaatgcagcctcatctcattttcagttaagggtactttatgtataattatgtcattgctgccttttatgtaggaaatgtaaaaaagttttaaaaggcgaaaataacattacagatttcatttttatacaggttacaatattaaacatgaaactaccaaattccaagaatagtaaaattctagagtcagttgattgattgaaactatttgacaaaacagttgaaagctgagctttcagtcaagaagttggtgaaattaatgtccttaaacttttcctttaggcaaaatgtcagggaaaacttaacatgaaagtagttactcccatacgcaccagtgcagtagctccaggtgtaagaggtcacgaaggcaccctgcccataaaaccaggatgtgcatacgtacacacaatcggtgtctggttatggttttctaaacactacataaggatctgaattttttagtgtgccaaaagcaaacgataggtttaaatgaaattgctcactaccaaatcaagactcttcatatatatacgtgtgtgtatatatatatgtcataacactttcacgtgtgacagcctaaggtttctttagttttaggatggggtggggtgggagtggttttgcatgtttgaccaggatgtgatgcctgtctttattccttgataagaagtagctgttacagcatttcaagcaaattattttaggtagaatagaacttactgccaaatgattatttatttagcaaaaattattctccaacttttcgaattcacaatttttctaagtgcatagagtagttttttacattgtcacgaattccttaatacctttatttaaaatggaaaaaatatggacaatattttagaaatatgtgctacacatctaattttatctgtagtttaagtgatctaaattgagatgcctttgatatgaagagatttaccaacattatatgcactcgtgccttcaatgtggaatcaaactggttaacctcagcacagtcctctcgtttctgtgtttctgctgcactaattgccagggggtgggggagaaggcgaatgaattaattcatagtagaaggaggcgataggtgcagcaaagggcagccacagtgttgattccacattataatgttgttgcctcttcttggcaaaagacaccacattgtgggaagatctcagcttccagggtaaaagttaatttataacttaaaagtgctattaagtttttattaccaaatatatcttttatggtttatattgtagtggtatgtatgaaacatttaaaattttactgtggaaattgtgtatatatatatatatagtcgaaataggtgttcacaggtcacatgtgaacggagaactgcatgaccgtacatgaaatgcaataaaccaactggaaaaagtgcatgtgcttcatcctctcaagccaactgcagctggaaagtgctgcttatcctccacccccagaaaatgcatgtatcaatatgagaataaagaacgcacactttcaattttattgaggctttcaacactatttaaaagaaaatgtaagaatttgacattctggagttattataacattagaaaatgagcataacattcactctgattttagccattaagggagattagtaaacagactgctacagtgttccatagttggactgtgcatccaaaacatttttttatctttaataaatggtacagtttttatgtagttttcgaatgtaagaagaaaggaatgctgaccaaaacttgatttcatcagcttcatgaaaaggactagtgtcattaacctgttgaacagaattggtttattaaaaaaatcatttccagtagtgtgaaacctttacgagtctttaacatctaaatgttatgactccttgtaccttaagttttccagtctttcttatttatatcatctccaagtacctctggctcctttcctcttgctcaccggaaccttagttttcctcaacagaatgctttgttaaagtagcccacagttgcaggatccatagcaccgtcgtgcagactagcagcccaaaggtgtgtttggtttggcttatacggtgttttgctttttaaactacttgccataatttaaaagtggcaacactagacttaaaaaaaaaaaagtctgattgcccatattagattttttttttaattcttcacaaaatctgctcttcctgaaagatcaaagtgtctagaaagcccaaacatgtattcttaacatagtaggcaccagctgaaactgagtaattaaacggtcccctgaagccaagtattccctggttagtcgccaccccaccactccttcctgtctctagtgtcacacttgggctgttgattttcttactcttctcttgctttaatccttccccccggctctctggctcctgtggatatctgtgcttgtttcctggtccaggatggtgatctgactttcaaaccagcttctcaaaaggggtgacataaaatcagttttgatgtttttcctcctgaaaaatcagatgaatattttagtcactgttactcatgcacattgtgttcttatgtttacagaagtgcttaagtgaatggaagcactagacatttggatttccttcctaacgtaatttttaatgattaccccttttatacagtaatttgtggtctttagaaagcagttaaactaattgaccatctaatagttgtactatacatatgtctaaaataatagtcatggtaagtttggcatcatatcttccccaaaaaatgtttattaaaattagattattccagtttaatgctattttgtgaactgtataccctctgaaagcgcttatttttacatgctacacaacagttccaattttaaggagtgtctcctaaaattgggatgaaaatctactgtagtctgttttaaagtatgctatactatgttcattggttacttaactggatattaatataaaggttattacaagaaaaatgatgaagagcaaaaggagaagaaaatatttgcaagtgaatccacaattcttgcagaactatttgagttgatactaaagattttatgttcactcctttaccttagaactgtcaagcttgggaatgaggaaagtgccttggctgtgcttgaaacctgaattttagtgcttcccttattacattcattgttttcaatgattgatttataaaattaagacatactggtagtacaagttgaaagttggtttgaatacattttaattaaatgataatatgttaatatgcttttgttcattgctttctcactgaggtaaaacagcattaaaaagttgtccagaatttaaactgaaaaaaaaaaaaaaaaa

SEQ ID NO: 303 - DNA, 9445 bp, Homo sapiens
gggataatgctcccggagaaggattctgcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacggaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagtgccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaagagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacct

SEQ ID NO: 304 - DNA, 5377 bp, Homo sapiens
gggataatgctcccggagaaggattctgcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacct

SEQ ID NO: 305 - DNA, 5470 bp, Homo sapiens
gggataatgctcccggagaaggattctgcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggttaggattttaaacaagaagatcgattttagcaaagttcagtccagatgtggttccaaggataacatcaaacattcggctgggggcggaaatgtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacct

SEQ ID NO: 306 - DNA, 2810 bp, Homo sapiens
gcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaagttaaaaaaaaaaaaaaaaa

SEQ ID NO: 307 - DNA, 2445 bp, Homo sapiens
ctcttagctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgaggtgggctgtaaggcagccatggtctttttccaatattgtgtcatggctaacttcttctggctgctggtggagggcctctacctgtacaccctgcttgccgtctccttcttctctgagcggaagtacttctgggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttggattggcaaaaaaaaaaaaaaaaaa

SEQ ID NO: 308 - DNA, 2699 bp, Homo sapiens
ctcttagctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttggattggcaaaaaaaaaaaaaaaaaa

SEQ ID NO: 309 - DNA, 2762 bp, Homo sapiens
ctcttagctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttggattggcaaaaaaaaaaaaaaaaaa

SEQ ID NO: 310 - DNA, 2808 bp, Homo sapiens
ctcttagctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcgggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttggattggcaaaaaaaaaaaaaaaaaa

SEQ ID NO: 311 - DNA, 3097 bp, Homo sapiens
acgcggcggcctggccaggcgaggcgggagccgagcaggccggagcgggccgcgcgccggggagggtcgcgccgcgcccgccccctccccgccacgcccggggcgcacgcgcgctcctctggccgcccctccctccgcgcggggacccctggcgggcggcaggaggacatggccagcgacgccgtgcagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggatccttgcaaaaaaaaaaaaaaaaaa

SEQ ID NO: 312 - DNA, 3122 bp, Homo sapiens
gtcgaggcaaggtatctggctgtgaccgggaggagtgcagatcgtggctgacagaggaacgggggtattgagcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatggtcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgccaaaaaaaaaaaaaaa

SEQ ID NO: 313 - DNA, 3240 bp, Homo sapiens
ggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatggtcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgccaaaaaaaaaaaaaaa

SEQ ID NO: 314 - DNA, 4261 bp, Homo sapiens
acttccggggcggaggaggctgagtggtgcagtgagggacaaacaaaaggaggcgccggagcagcgctgcggccggcggcgggacggagcggccggggcctggggctgcctgccgggcggccgggcgcggcgagcccaggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgcgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccctgtcgccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaaaaaaaaaaaaaaa

SEQ ID NO: 315 - DNA, 4368 bp, Homo sapiens
acttccggggcggaggaggctgagtggtgcagtgagggacaaacaaaaggaggcgccggagcagcgctgcggccggcggcgggacggagcggccggggcctggggctgcctgccgggcggccgggcgcggcgagcccagggaggcagcgtccatggagcaaaaggaatgccaggatcctgcacaggcagacgcgggccagcctcagcaccgacagccgacgcgcagatagcagagccatccttggggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgcgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccctgtcgccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaaaaaaaaaaaaaaa

SEQ ID NO: 316 - DNA, 4629 bp, Homo sapiens
ggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcatcctgcctcctgttcccattcctagtagctaaa

SEQ ID NO: 317 - DNA, 3958 bp, Homo sapiens
ttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctaccatgcaggatttgaatttgtcttttaatttagcttaggaaagaacatcactgggcgagcggtaaatcctaaagaaggtgataaatgtcagtagtttcttattaaatattctaattttaggttcccaaaccttcaggaaatatatcttaatgcagacaaacaaacataaaacttctttagtacttacatcaggaaatttggggcagattttagaggggggaaattataggaggaaagaagttcacatcagaacagacaatcacagcaatgctctattccttagaaattagtgccacaaataagttacatctacaaacaggtggtaaaaattctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaagatagccaaataattggcatgtgaattatttcctgcttattcataataaataatgactgtcta

SEQ ID NO: 318 - DNA, 2358 bp, Homo sapiens
ttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctaccatgcaggatttgaatttgtcttttaatttagcttaggaaagaacatcactgggcgagcggtaaatcctaaagaaggtgataaatgtcagtagtttcttattaaatattctaattttaggttcccaaaccttcaggaaatatatcttaatgcagacaaacaaacataaaacttctttagtacttacatcaggaaatttggggcagattttagaggggggaaattataggaggaaagaagttcacatcagaacagacaatcacagcaatgctctattccttagaaattagtgccacaaataagttacatctacaaacaggtggtaaaaattctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaagatagccaaataattggcatgtgaattatttcctgcttattcataataaataatgactgtcta

SEQ ID NO: 319 - DNA, 1300 bp, Homo sapiens
ctgcagccggtgcagttacacgttttcctccaaggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgtcagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcctggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagccgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaaccacaaaaaaaaaaaaaaaaaaaaaaaaaaaaaaaaaaaaaaaa

SEQ ID NO: 320 - DNA, 988 bp, Homo sapiens
ctgcagccggtgcagttacacgttttcctccaaggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcctggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagccgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaaccacaaaaaaaaaaaaaaaaaaaaaaaaaaaaaaaaaaaaaaaa

SEQ ID NO: 321 - DNA, 2414 bp, Homo sapiens
acttagcagagaagaatcaaatttccgggggcaaagcaaaataataaaatgaatgtcaggatattttatagtgtcagtcagtcaccccacagtctcctctctcttcttttctactgtgctatcctagaatcaaggatttcagcaacaatgcctctgttcaaactcccagaaattgatgatgcaatgcgcaactttgctgaaaaagtgtttgcctctgaagtcaaagatgaaggaggtcgtcaggagatttccccctttgatgtggatgagatctgtccgatttctcatcatgagatgcaagcacacatattccatctggagactctgtccacctccacagaagccaggagaaaaaagcgtttccaaggacggaagactgttaatttgtccattccactaagtgaaacatcttccaccaaactgtcccacattgatgaatacatttcctcatctccaacctaccagaccgtgcctgattttcagagagtgcagattactggtgactatgcctctggggttacagttgaagattttgaaattgtttgcaaaggtctgtatcgggcactatgcatacgtgagaaatacatgcagaagtcgtttcagaggttccctaaaaccccttccaaatacttgcggaacattgatggtgaggcttgggtagcaaatgagagcttctatccagtctttactcctcctgtgaagaagggagaggaccccttccgaacagacaaccttcctgaaaacctgggctatcacctcaaaatgaaggacggtgtagtttacgtctatcctaatgaagcagcagtcagcaaagatgagcctaagccacttccttacccaaatctggacaccttcttagacgatatgaattttttacttgctttaattgctcaaggacctgttaagacctatacccaccggcgcctgaagttcctctcctccaagttccaggtccatcagatgcttaacgagatggacgagttaaaggagctgaaaaacaacccccaccgagatttttataactgcaggaaggtggacacccatatccatgcagccgcttgcatgaaccagaaacatctgctgcgttttattaagaaatcttaccaaattgatgctgacagagtggtctatagcaccaaagagaagaatctgaccctaaaggaactttttgctaaattaaaaatgcatccttatgacctgactgttgattctctggatgttcatgctggacgccagaccttccagcgttttgataagttcaatgacaaatataatcctgtaggagcaagtgagctacgggacctctacttgaagacagacaattacattaatggggaatattttgccactatcatcaaggaggtaggtgcggacctggtggaggccaagtaccagcatgctgagccccgcctgtccatctatggccgcagtcctgatgagtggagcaaactctcctcctggttcgtctgcaatcgcatccactgccccaacatgacatggatgatccaggttcccaggatctatgatgtgttccgttccaagaatttccttccacattttggaaaaatgctggagaatattttcatgccagtgtttgaggccaccatcaacccccaggctgacccagaactcagtgtcttcctcaagcatatcactggctttgacagtgtggatgatgagtccaaacacagtggccacatgttctcctccaagagtcccaagccccaggagtggacattggaaaagaatccatcttacacttactatgcctactacatgtatgcaaacatcatggtgctcaacagcctgagaaaggaacgaggcatgaatacgtttctgttccgacctcactgtggagaagctggagccctcacccatctcatgacagcattcatgatagcagatgatatctctcatggcctaaatttaaaaaagagtcccgtgctacagtacttgtttttcttagcccaaattcccatcgccatgtcaccactaagtaacaatagcctatttctagagtatgccaaaaatccttttttggatttccttcagaaagggctaatgatctcactgtctacagatgacccaatgcaattccactttaccaaggagcccctaatggaagaatatgctattgctgcacaagtcttcaagctgagcacctgtgatatgtgcgaagtggcaaggaacagtgtcttgcagtgtggaatttctcatgaggagaaagtaaagtttctgggcgacaattaccttgaggaaggccctgctggaaatgatatccggaggacaaatgtagcccaaatccgcatggcctatcgctatgaaacctggtgttatgaactcaatttaattgctgagggtcttaaatcaacagaataaaaaaaagtaaaccaaaaaaaaaaaaaaaaaaaaaa

SEQ ID NO: 322 - DNA, 3196 bp, Homo sapiens
gtgtgactctgtgccagagcaattgactaaaactctcaggttttagatatcaagccaccggggacttcatgagccaagtcccttccattcctttccaggtgcatagaacttcccacaagagtgtcagcactgtgctttcatcccgagcatcttgtttctgtcattcttattcttctacccatcttcacagcaatcattttcttcacttttctttttttttttttttcgtcttggcccattgcacaccctaagacaaagcaatccatttttgttgttgttgttgtttgtgtgtttgtttgttttttgagacagagcctcgatccatcatccaggctgcagtgcagcagcgccatcatgactctctactgcctcaacctctcaggcccgagcaatcctcccagcttcctgagtagctcgggcctcagggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggcctttccagaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactcccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaagagaataaaagcaggctgcctgagccagcagtgacaacccccctcgggtcccctcccacgccgtggaagctttgttctttcgctctttgcaataaatcttgctactgcccaaaaaaaaaaaaaaaaaa

SEQ ID NO: 323 - DNA, 3903 bp, Homo sapiens
cctttagagatcggtggtgctgaagggcagggatcttattccaccttctgaagcttctgtcgaaccagttgtaaggagaatggagagagcagtgagagtggagtccggggtcctggtcggggtggtctgtctgctcctggcatgccctgccacagccactgggcccgaagttgctcagcctgaagtagacaccaccctgggtcgtgtgcgaggccggcaggtgggcgtgaagggcacagaccgccttgtgaatgtctttctgggcattccatttgcccagccgccactgggccctgaccggttctcagccccacacccagcacagccctgggagggtgtgcgggatgccagcactgcgcccccaatgtgcctacaagacgtggagagcatgaacagcagcagatttgtcctcaacggaaaacagcagatcttctccgtttcagaggactgcctggtcctcaacgtctatagcccagctgaggtccccgcagggtccggtaggccggtcatggtatgggtccatggaggcgctctgataactggcgctgccacctcctacgatggatcagctctggctgcctatggggatgtggtcgtggttacagtccagtaccgccttggggtccttggcttcttcagcactggagatgagcatgcacctggcaaccagggcttcctagatgtggtagctgctttgcgctgggtgcaagaaaacatcgcccccttcgggggtgacctcaactgtgtcactgtctttggtggatctgccggtgggagcatcatctctggcctggtcctgtccccagtggctgcagggctgttccacagagccatcacacagagtggggtcatcaccaccccagggatcatcgactctcacccttggcccctagctcagaaaatcgcaaacaccttggcctgcagctccagctccccggctgagatggtgcagtgccttcagcagaaagaaggagaagagctggtccttagcaagaagctgaaaaatactatctatcctctcaccgttgatggcactgtcttccccaaaagccccaaggaactcctgaaggagaagcccttccactctgtgcccttcctcatgggtgtcaacaaccatgagttcagctggctcatccccaggggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactcccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaagagaataaaagcaggctgcctgagccagcagtgacaacccccctcgggtcccctcccacgccgtggaagctttgttctttcgctctttgcaataaatcttgctactgcccaaaaaaaaaaaaaaaaaa

SEQ ID NO: 324 - DNA, 1483 bp, Homo sapiens
agattttaagcccattctgcagtggaatttcatgaactagcaagaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaaaaaaaaa

SEQ ID NO: 325 - DNA, 2882 bp, Homo sapiens
atctgaaaaattaataattccttaattatcaaatatccattatttaaatttataattgtgtcataaatattgtcataaatagatttgctgttttaaagcttgttccttcattttctctgttttgttttagataaacattgtcataaatagatttgttgttttaaagcttgttccttcattttctctgattgttttgttttagattcagaggttacttatgcttgtttgttacatggatgttacatgtgtaatgggggatattggacttctagtgtactcatcacccatatactgaacactgtactcaaaagggattgaaagaaactaggaaacttggcaggaagatcattcttaagccaggaaaaaaatttttaatgctcacatgtgaacatgtgatggtcataccagaaggagcacccacctccctccctctgtgacagacacattttcttagccttcacctttccttctttcaagttgctgaaaatccacagtgtttctgttcatttgttactttcattctcacctatcttctctcttgctccatctaccagaacaataattccccatataatacttctcacttcacttttcaacgcaggacctcttgttgggtctgatctgtttgtctgtccgctttatcaatattatcagatgtaagtttacatgaatacacacacatattcactaaactgaggggaaaaaatgccttgtaggtcataaaaaagcagggaaattcccaacaattcatatttgatccctggatccaggggtggcagcaataagcctgctttagatatttactccccattttatgatccggtggtttggtttttcaaatgatgatatggctcctttcgcaatgacttgatgtttaggaggtgtgcttcaataaatacattttaaaatcaacaatcaagttagagttgtacaaatggctctgaaatgtcccactacactgttagaccaagggcacagattgtgcttctgtactatttatcctagtatccctcggcatatattaactgctctaaaaatctccttggctacacgctgcatcaaatcaaagttaaatgttataccacctttctattctatttttaatattcaaagagggtgctcagattttagaacaaatttcaatgtttaagtacacacaaaaaaatcattaactcatatatttcaagagtaggaaatgggaactggtgttaaaactcttataacaaatgtcactgtcttaagggacagtgtttaaaaacgcatacctggccgggcgcggtggctcatgcctgtaatcccagcactttgggaggccgaggccggcggatcacaaggaaaacaaactcaggaagaaaaagaaaagcagaagtgatcaaggagagcgctcgagttgcaatattttcctttggctgctgacaggcagttactataaagcattgtgcatggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaaaaaaaaa

SEQ ID NO: 326 - DNA, 1993 bp, Homo sapiens
aggaagaaaatataaagtacacttttaaaacatgaagtcttcatagcagcttatagtcgttcagagaaacatgttccactgagaatgacttgagagagaggattacatcattatgccagaaggaagaagccactgtgcatgctctatcaccagcctcaccctcctggtcagccttacaagagtgacactggatatactccagaagttggacccaccacagcctgcacactggacttcttggcttttatgagctattcaagagatatttagtcatcacgttgtgtcacaatgggagtgactcacagagcaaggagagaacctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaaaaaaaaaaaaaaaaaaaaaaaaaaaaaaaaaaaaaaaaaaaaaaaaaaaaaaaaaaaaaaaaaaa

SEQ ID NO: 327 - DNA, 2090 bp, Homo sapiens
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagctaaaaaaaaaaaaa

SEQ ID NO: 328 - DNA, 1955 bp, Homo sapiens
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggcagctggatgtcatgccgaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagctaaaaaaaaaaaaa

SEQ ID NO: 329 - DNA, 1652 bp, Homo sapiens
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactgggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagctaaaaaaaaaaaaa

SEQ ID NO: 330 - DNA, 1937 bp, Homo sapiens
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagctaaaaaaaaaaaaa

SEQ ID NO: 331 - DNA, 1805 bp, Homo sapiens
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagctaaaaaaaaaaaaa

SEQ ID NO: 332 - DNA, 2357 bp, Homo sapiens
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagctaaaaaaaaaaaaa

SEQ ID NO: 333 - DNA, 3036 bp, Homo sapiens
acttctccttttgctctcagatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaaaaaaaaaa

SEQ ID NO: 334 - DNA, 3181 bp, Homo sapiens
acttctccttttgctctcagatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaagagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaaaaaaaaaa

SEQ ID NO: 335 - DNA, 2769 bp, Homo sapiens
acttctccttttgctctcagatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaaaaaaaaaa

SEQ ID NO: 336 - DNA, 2773 bp, Homo sapiens
agcctgagaatagttagcaaacaagggaggttgtcatttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatctcgactcccatccccatctatctgtgccctgagcatggctctgcccccaggtcgtcttgcacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaagttctatgctaaaggcaatttatcttgatgtgatgataaaccaaacttattagcaagatatgcatatatatccataaattctctttactctgtctccatcacttgatgcacataagtgccctgacctcagcatctcccctctaaaaaaaaaaaaaaaaaagtatctctttatctttcttccatagcctgacactgatatttgtgcacttaccttaactttggtctattttattcatccaaaaccattacatttcttggttttcacaaatgttccccatttcttagccagttccagacaatgtatagcaagcaggggaaggaaagcagtcaggagttcctgggtggccacggctctgcaatagcacttatgtcatggaagtgatatcccacctcctacatatactctttgcctaggtttttggaacaaggttatagtcagacactgtatctttagattgatgtcgaccacaaagttcagccagagcttgaggctagatgcacagccttgctattgggaagaaggccttttctagctgtacaacacagtctcactgggcattcatccagaaatagagaagaaagtctgccagacttgagttatgttgtcttttattagcagggaatgtcatcacagattggatagtacatccaggtgcaatgtcaccatcagcaaggtcagcttgacactcaagtggaagattagggaagaatgactaggataaaaaaaaaaggagggcaccaagggaaagggatgatggggtgagctggcgagtgtgggtgggaaatgaaatgtttattgaggatctgctttgtgctgggcactttaatccacattttatcgtttacttttcaaacagatgcaccttacccccaccccaatgctctgtccctgcagatatcagaagacagtgtgattttcatgctctgaagttcagttttacatccaagcatccctctctgttttttaacaatccaaagacaggccaaaaaaagcaccacagtttattaagtacttactaagcacccatccactgccccacactgtggcaaggattgtgaggggtaaagaagcatggggcacaatattctgctgccttcatgtaacttacagtctcacaaataaatagaacttcagttgaaatactgacattaattaaatagagttgtaataaaaaaaaaaaaaaaaaaaaaaaaaa

SEQ ID NO: 337 - DNA, 2835 bp, Homo sapiens
gggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatctcgactcccatccccatctatctgtgccctgagcatggctctgcccccaggtcgtcttgcacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaagttctatgctaaaggcaatttatcttgatgtgatgataaaccaaacttattagcaagatatgcatatatatccataaattctctttactctgtctccatcacttgatgcacataagtgccctgacctcagcatctcccctctaaaaaaaaaaaaaaaaaagtatctctttatctttcttccatagcctgacactgatatttgtgcacttaccttaactttggtctattttattcatccaaaaccattacatttcttggttttcacaaatgttccccatttcttagccagttccagacaatgtatagcaagcaggggaaggaaagcagtcaggagttcctgggtggccacggctctgcaatagcacttatgtcatggaagtgatatcccacctcctacatatactctttgcctaggtttttggaacaaggttatagtcagacactgtatctttagattgatgtcgaccacaaagttcagccagagcttgaggctagatgcacagccttgctattgggaagaaggccttttctagctgtacaacacagtctcactgggcattcatccagaaatagagaagaaagtctgccagacttgagttatgttgtcttttattagcagggaatgtcatcacagattggatagtacatccaggtgcaatgtcaccatcagcaaggtcagcttgacactcaagtggaagattagggaagaatgactaggataaaaaaaaaaggagggcaccaagggaaagggatgatggggtgagctggcgagtgtgggtgggaaatgaaatgtttattgaggatctgctttgtgctgggcactttaatccacattttatcgtttacttttcaaacagatgcaccttacccccaccccaatgctctgtccctgcagatatcagaagacagtgtgattttcatgctctgaagttcagttttacatccaagcatccctctctgttttttaacaatccaaagacaggccaaaaaaagcaccacagtttattaagtacttactaagcacccatccactgccccacactgtggcaaggattgtgaggggtaaagaagcatggggcacaatattctgctgccttcatgtaacttacagtctcacaaataaatagaacttcagttgaaatactgacattaattaaatagagttgtaataaaaaaaaaaaaaaaaaaaaaaaaaa

SEQ ID NO: 338 - DNA, 3999 bp, Homo sapiens
tgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagataggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagatttttttaatttatattttcatcctgaccagcttagttctaataatttttagttgtgagtgattaaaaaactttggatcaattttggtcaaacatgccaactttgtagtctgagtgacaggcaaggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactcta

SEQ ID NO: 339 - DNA, 5329 bp, Homo sapiens
acctcgcactctcagtttcaccgctcgatcttgggacccaccgctgccctcagctccgagtccagggcgagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggagccaagcagctcaccctggaggacccgcagatgtccatgagccacccctacaccatgacaacgccttacccttcgctcccagcccaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggttgccaggtgacaggaaccttttatgcttgtgccccacctgagtcccaggctcccggagtccccacagagccaagcataaggtctgccgaagccttggcgttctcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcagagctgcaagcgtttgctcaccacggccgctccctgccaagattccaggtgactctatgctttggagaggagtttccagaccctcagaggcaaagaaagctcatcacagctcacgtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggggatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaattcagaagtggagatttcagttcagcggttgaggagaattgcggcgagacaagcatggaaaatcagtgacatctgattggcagatgagcttatttcaaaaggaagggtggctttgcatttcttgtgttctgtagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccgccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgaaatgagcagcccttacagtattgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctccccaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagtttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaatttgttaaaaaa

SEQ ID NO: 340 - DNA, 3708 bp, Homo sapiens
agtgcgcaggcgcgcgctgcgacgccaacctcggcttctcgccgctaacggcatcgagtctggacgccccgtgacccgcctgggccggagcgggggcggacggcgccttcttggccctttctgcctctagcagcggcgccggggtagccggagccagcgactgggaaacggctgcattccactgcgtctccttggcctggctgggcggtcggaggctgatctgccaagattactgtttggagaccgctgcagcccacgtccacctgatagactatttactacacatagtaggttcagagccgctaaatgtccaagaccatggcgatgaaccttctggaggattggtgcaggggaatggaagtggacatccacaggtccttgttggtcacaggcatcccagaggactgtgggcaggcagaaattgaggagaccttgaatggggtcctctccccactgggcccgtaccgcgtgctcaacaagatttttgtgagggaagagaatgttaaagctgccctcattgaggttggtgaaggtgtgaatctgagcaccatcccccgtgaattcccaggaaggggtggtgtctggagagtggtctgtagagaccctacccaggatgccgagtttttaaaaaatctgaatgaattcctggatgccgaggggcgcacctgggaggatgtggtccgcctgctccagctcaaccaccccaccctgtcccagaaccagcatcagcccccagagaactgggcagaagctctgggggtgcttctgggagcagtggtgcagatcatcttctgcatggatgccgagatccgcagccgggaggaagccagggcccaggaggccgctgaattcgaggagatggcagcctgggctttagcagcagggaggaaggtgaagaaagaaccggggcttgcagcagaggtgggttctgccttaaaggcagagacccccaacaactggaatgccacggaagaccagcatgagcctaccaaacctttggttcgcagggctggagctaagtctcgctccaggagaaagaagcagaagaagaactccaggcaggaagcagtgccctggaaaaaacccaaaggcatcaattccaacagcacagctaacttggaggatcctgaggtgggtgatgctgaaagcatggcgatctcagagccgatcaagggcagcagaaagccctgtgtgaataaggaggagttggctttgaagaagcccatggcgaaatgtgcctggaagggtcccagagagccacctcaggatgcccgggcagaagccgagagcccaggaggcgcctctgagtcagaccaagatggtggccatgaaagcccaccaaagaagaaggccgtggcctgggtgtctgccaagaaccccgctcccatgaggaagaagaagaaggtgagcttgggccctgtctcctacgtcttggttgactcagaagatggcaggaagaagccggtgatgccaaagaaagggccaggctcaagaagggaggcatcagatcagaaggcccctcggggccagcagcctgccgaggcaacagcctcaacctctaggggtccgaaggccaagccagaaggctctcctcggcgtgccaccaatgaatccagaaaggtttgatctgggggaccacccatactgaggagttgaaagaacaaggaagaagtaccaagtcaaccaagttctctcttgtcactgaataagactttggactctcttagggcccctgttgatagagatctggccctgaggtaaacgataggtgaggtcttgggtgggagggagttggggaagggaggtggatctctatgcccttttctctaccaggcctgccgtttcaccgccttctctactcaccttctcttcggaggcaggagagttggtaagaggattgggaaaattctagaacattcattcccctttatgcatgagcagggtcactgttacactcatccatgttcagcttttctcccccacgccttgctccctcctcggaatggtcagcgacctctgcaggccctggcatttggaagagctgggtggccctgccatattcttcctcccgccttcctctcgtgtaaccagcggggtaagttaagccaggaccttcgctgcaaacctggttttattgctccttcagtctccagcttccatcctccagttatctagccaggaggtcccaagagttagttttagggaaaaagaatgtctgcctagacctcaaagtctttgagttttagagtctgttagtaaaaatggcactttgattcccatttgggatgagccctctcaggaatcctgtggggaaggggggtgattatagggaaggacgcaggcattcctaggtccccagctctaattccatccatctacccaactgtcaccatctttgcaccaaactgtcaccatctttgcagcagaaggtcactactcacattatagtaagaggggaaaaaaatcttttaaaacttggctgttggccgggcacggtggctcacgcctgtaatcccagcactttgggaggctgaggcaggtcgatcacgaggtcaggcgtttaagaccagcttgaccaacatggtgaaaccccatctctacaaaaattagctgggcgtggtggcgcgcgcctgtaatcccagctactcaggaggctgaggcagatgaattgcttgaatccaggaggcagaggttgcaatgagccgagattgtgccacggcactccagcctgggcagcagagtgagactctctctcaaaaaaacaaaacttggctgttaatgtctgccctctgaattcagacacactatattagaccagaccaccatgtgtcattgtgtgtgtgtgtgtgtgtgtttgcgtgcgcatgtgtagaggagagagcagggtccctgagataatggtttccaaactgtatcgtagccgtccacaaagatgtaatccaaatctatttttctcacgtgtttaaaaaactgaaaagtgactactcagatatgttggaagtcacatcgaagactatcagaatattaccttgtgttcataggttaacttgtttttgtacacgtcttagttatttcaggcatctctttgcttaaaattgagtttcttgtaaatgtgactgatgagcgaggttagaagtggaagaaattcctgtgcatgttctataatctgacaccctgaaagcaagtttcctttcgtcattcacatgctcttgttctgccgtgactgttcaggtgtatggtagtaagtaaatgtattaacatggtgaacagtagtaatattctatcatagagtattagcccttgcaagttttcagggcgtcttttccgacttcagtttttgtgataaagaatgtgaacagttgttagatgttctcagtgattcaactttaaaacaaatttctcgtgatgattcatttcaaaatcctgagtgagtctgactgaaaaatacgagagaaaagagagtggtttccgtttgcagctacacagctgtgtgcatcgacgttctcctggggtgtgtgccaagcgaaacccaggggtgaattggattcttgaagagaccaaagcctgtaactgtccagcttctaatttcaaaacgggtccattagggcttcgttgtgttaacaagttgacaccatgactagtaaatgtaaacgtgtatgtataaaataaagtttagcaaattaagtgtcctgttaaaaaaaaaaaaaa

SEQ ID NO: 341 - DNA, 4710 bp, Homo sapiens
cgctgccccgtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcagccgcgcgccgccccggtccagccgccatgccgactgttctttgttacattcgccggctgcgggcaccgttggcgatcggagtcaaaacccggctggatttcccggagccgctccgggatcgccctgcgcgccgcccgcccgccggggtcttcgccgccccggcccgcggccccgcggcccccgccgccgggcggcgtcgtcgccgaggccccaggggatgtcgttatcccccgccctcgggtacagcccatgcgggtcgcacgggggggtccctggacccccaaccccgcgtttagagaagctgagtcctggtcccagattgggaaccagagggtcagtgagcagctcttggaaacatctctagggaatgaggtgtccgacactgagccactgagccctgcgagtgcaggcctgcgacgcaatcctgccctacctcctggaccctttgcacaaaacttttcctgggggaaccaggaaaatctgcccccagccctggggaagattgcgaacggaggaggaactggggcaggcaaggccgaatgcggctatgaaactgagtcacacttgctagagccgcacgagatacctttgaacgtgaatacacacaagttcagtgactgtgagtttccatatgagttttgcacggtctgcttttcacccttcaagctgctggggatgagcggggtggagggcgtgtggaatcagcattcaagaagtgccagcatgcacactttcctaaaccactcagcaacgggcatcagagaagcaggttgcaggaaggacatgccggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcttggcctgccagcggacacgtgcacacccaggcggggcaggggatgcggggttatgaggacagggacagggctgacccacagcagcttccagaagcagtccctgcaggcctggtgaggcggctcagtgggcagcagctgccctgccgttccaccctcacctgggggaggctgtgccacctggtggcccagggcaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggatac

SEQ ID NO: 342 - DNA, 3199 bp, Homo sapiens
gtggggggcgcgcgcgcgggcccggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 343 - DNA, 3063 bp, Homo sapiens
gggtaatgaaggggagcgagcgagggggagcaaggagcatggagctgcatactgatgagtgacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 344 - DNA, 3157 bp, Homo sapiens
gtaacgtataaccagtatgaagattcaattcagatttaagcactttggtttgcttttgaatcttgctattttctgcatttgttttgactgctctcatcattcaagattgacgcttggatgggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 345 - DNA, 3639 bp, Homo sapiens
acttgataaaaaagaattctggctgccggccgtgcattgctcattgtggagtactccaacaatcacatagaacgcagaccagcccaagctgacagcttgatatgccttcttctgctgcctggttttgggggctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcctttctgttttaaagcagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 346 - DNA, 3515 bp, Homo sapiens
acttgataaaaaagaattctggctgccggccgtgcattgctcattgtggagtactccaacaatcacatagaacgcagaccagcccaagctgacagcttgatatgccttcttctgctgcctggttttgggggctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 347 - DNA, 3443 bp, Homo sapiens
acttgataaaaaagaattctggctgccggccgtgcattgctcattgtggagtactccaacaatcacatagaacgcagaccagcccaagctgacagcttgatatgccttcttctgctgcctggttttgggggctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 348 - DNA, 3199 bp, Homo sapiens
gtggggggcgcgcgcgcgggcccggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 349 - DNA, 3127 bp, Homo sapiens
gtggggggcgcgcgcgcgggcccggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 350 - DNA, 2043 bp, Homo sapiens
gtggggggcgcgcgcgcgggcccggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttgatagaattgaatttacatatagctgataaagcctaaatagaaaggttgatgtatttagcttgaatccttcactttagtggtctaatcaacagataaatgacaagcaaagaatgaaacaatccaaaaatgtttttcaaaacaattttgtgaattttatttttacaaaaattttttaaattcatattttaaaatgtataccaaggcaaaaaaatcatataagctatatcataaatacaagagtttcaaaacatacaagagacatataatgtaaaaaaaaattatatatatgaagtccaatgtaatttataatacaaaaaaatacagcaagggaaaatgctttagaaatgctcatctgcaaactacaaaacaaaatcctcctcttgaccgactgcatgaactgccatgaaatttgcagctccatcatactaggtatctcttctttcttcatgttaccttgtctttcttcccatttttcttttaagacagggtcttgctatgtcacccaggctggactcaaactccagggctcaaggaatcctcctgtcttagcctcccaaggagctgggattacaggcacgtgccaccgcacctggctcctaatttctttttaagacaagggccattcaaggctttttaaaacctgatgtgtgttgttatactttataacagtcagtggcttttaattccaaaaggtaatactttatactctgcctacatgagatgagcccctaacagtgtgtacaaataaaattatgatttgggtattctaaaaaaaaaaaaaaaaaaaaaaaaaaaaaaaaaaaaaaaa

SEQ ID NO: 351 - DNA, 2359 bp, Homo sapiens
acttgataaaaaagaattctggctgccggccgtgcattgctcattgtggagtactccaacaatcacatagaacgcagaccagcccaagctgacagcttgatatgccttcttctgctgcctggttttgggggctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttgatagaattgaatttacatatagctgataaagcctaaatagaaaggttgatgtatttagcttgaatccttcactttagtggtctaatcaacagataaatgacaagcaaagaatgaaacaatccaaaaatgtttttcaaaacaattttgtgaattttatttttacaaaaattttttaaattcatattttaaaatgtataccaaggcaaaaaaatcatataagctatatcataaatacaagagtttcaaaacatacaagagacatataatgtaaaaaaaaattatatatatgaagtccaatgtaatttataatacaaaaaaatacagcaagggaaaatgctttagaaatgctcatctgcaaactacaaaacaaaatcctcctcttgaccgactgcatgaactgccatgaaatttgcagctccatcatactaggtatctcttctttcttcatgttaccttgtctttcttcccatttttcttttaagacagggtcttgctatgtcacccaggctggactcaaactccagggctcaaggaatcctcctgtcttagcctcccaaggagctgggattacaggcacgtgccaccgcacctggctcctaatttctttttaagacaagggccattcaaggctttttaaaacctgatgtgtgttgttatactttataacagtcagtggcttttaattccaaaaggtaatactttatactctgcctacatgagatgagcccctaacagtgtgtacaaataaaattatgatttgggtattctaaaaaaaaaaaaaaaaaaaaaaaaaaaaaaaaaaaaaaaa

SEQ ID NO: 352 - DNA, 3695 bp, Homo sapiens
acttgataaaaaagaattctggctgccggccgtgcattgctcattgtggagtactccaacaatcacatagaacgcagaccagcccaagctgacagcttgatatgccttcttctgctgcctggttttgggggctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 353 - DNA, 2715 bp, Homo sapiens
gcgcgcccgggtagccaagagggaggagcgcggggagcgccgacagccgcccgcccgcccgcccccgcgacgcccgcgcgcaacagttcccccaaagttgcagcccgggaggcgagcgcgcacgggcggccgaggggcgggcggttggcggggacgcggcctcgcggcccagagcggagagtcccggcgggcggcggcggcatgggcacccggcagaccaagggcagcctggcggagagagccagccccggcgccgcgccgggcccccgacgcgaacggccggacttctgggcgtcgctgctgctgcgcgccggggacaaggcggggcgcgcgggcgcggggatgcccccctaccaccggcgagtcggcatggtccaggagctgctgcggatggtgcgccagggccggcgggaggaggcggggacgctgctgcagcacctgcgccaggacctgggcatggagtcgacctcgctagacgacgttctgtatcgctacgccagcttccggaacctggtggaccccatcacacacgacctcatcatcagcctggcacgctacatccactgtcccaagccgcctcaaggctgtcctggccggaagccccccagacaacacagtggacctgtcgggaatcccactgacctcccgagacctggagcgggtgaccagctacctacagcgctgtggggagcaggtagacagcgtggagctgggcttcacaggcctcacggacgacatggtcctgcagctgctgccagcactcagcaccctgccccgcctcaccacactggcactcaatggcaaccggttgacccgggccgtgctgcgcgacctcactgacatccttaaggatcccagcaagttccccaatgtcacgtggattgacctgggcaacaacgtggacatcttctccttgccccagcccttcctgctcagcctgcgcaagcgctccccaaagcagggccacctacccaccatcctggagctgggtgagggcccaggcagtggggaggaggtccgggaagggacagtaggccaggaggaccctggagggggccctgtggcacctgccgaagaccaccatgagggcaaggagactgtagctgcagctcagacgtgacatggaagtgaagggcctcaccagggagtccttgttgggtagaatgggcaaggcaggcaggggagggcgcttctcctatcaggtgggttaaggatattgccaaaaattggcctgggccacccacctacagaaaggcaaaccatatcatctggggaaggggatttgtgttaaaacttcccgttggtcctctgcatctgccccctatcccattatctgccatttggttcttaagtcatcccaggccccagagaaccctctcagctcagctcatggccttccccaaagacttgtggaaatgggcacatggctggaggtactgtaagcctgagccattgtgaacaccaagagctttcccccagaaaaagaatacagtagggcccctacatgtactgcattacatttttcatttaggggaacaagctccaaccagaggaatgtgtccccactcaaggaaggtgggaatctttagcaaaattcctgtaactcctggttgcccgagaccccagttccatctatgctaggggtggactgaacgtggcctacctccttatggagacccagccctatttctgaggcccaccttgattctaggcatctgcccataggaccagctatcgctatatcctttgacagagcagcctacgatgccatgtggtagtgctcaggacagacatggtgcccatgcatacaggcataaagtcctgttcagaaatcccctatccaccttccctacccactgctggctgaaaaactaccagacttctatgtgggctctgatgtccttagcatgcagggtaagtgacaaacctggcttccttcttgtcacttgccagtatgacttcactgacctagacaggccgtaagaactctttccccataactcttaagtaatccaccaacacattccagaaaaccgactgcagaaggtgggctttaaaaccttaaaaacctaggacaatgaaggagtccaatcccttggcagatccaacaagatggctggggagagggagaaacaaactggaggctcccaaaggaacctaacttagcaaaggttctcatcttataccctccccttacccaaatactgtcctactgaaagggccctaccagttaagggatctcttctaaataacaggcaacccctagatccaagtagttcagtccaggaagactgggagccaatcactcttgaaccttgtgggcaaacagtatgggggaggaccctcttgacaggccttggtaggcaagattccaacacaggaagacagcaagatggggcctagagtatggggccctacatgctgttaaggttgtggttaggaatggtgcaatgctgcaggagctggaacaaagctacaccaaggaacagagcacagagcagcaggggccgaaattgaggaggccttaaatgctttgagcttttgccttcagtctaaagctgtagaatagggggttaagagcttaggctgaccacagggaagtttacaagctagagcgaatatctggactgctaatatctgacaacagtaggcgaaatttactttttcttcaaatacacattttcaagaattgacacccaagacaaaaaaaaaaaa

SEQ ID NO: 354 - DNA, 2560 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatataaaaaaaaaaaaaaaaaaa

SEQ ID NO: 355 - DNA, 2644 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatataaaaaa

SEQ ID NO: 356 - DNA, 2266 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttataattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatataaaaaa

SEQ ID NO: 357 - DNA, 2653 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatataaaaaaaaaaaaaaaaaaa

SEQ ID NO: 358 - DNA, 1391 bp, Homo sapiens
gcacaaccccagcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccggatagaagcggctacattgacgagcatgagctggatgcccttttgaaggatctgtacgagaaaaacaaaaaggaaatgaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaatgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaacttacccaaaaaaaaaaaaaaaaaa

SEQ ID NO: 359 - DNA, 1144 bp, Homo sapiens
tccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatgagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgca

SEQ ID NO: 360 - DNA, 2944 bp, Homo sapiens
agactgaagccagtggcgctgcgctgaatgcaactgcgcgcgcccgccgggtgagccagcgatctgagccaggcgggggcggcccgacctttcccgcccagcctgggtcagaggaagccgaaagcggcctcagcaaggtgaggcgcccgaggctgcagaagaccgagcagaactttgcagagttcgggatgtgctgggctaggtcgctgaggacttgactggcttcctccctccttccctccacctaccttctccctccccctccaccatccagtgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttgagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaagttctccttggattattctacagctattatgtgtacataatgaaccatctttagaaaataaaagtgacatcagctctaggtatagatatattttttaataatgaaaaaagatgacatggataataataaaacattgattgatacaagataaatagtcttgtctcttaatgcgtagggggcctgggaagaatattaaaattttaatcaataaagtatgtctgttgaagcaagcaagcaaacaaatccataacaaccacaacaagcaacaagaacaagaacaacaacaagaagaagttgcagtatggatatctttcaccctcccaggaaactctttcaaacctaatctgtacttttgcatctgtataaaaatatcagtgagatggaactgtaaataattgttctgctgatctgtagtgttgctgttaccttctgggtttccacatttttattccgtagatgttaatctctttcatgtgcaatctttgcttcttgtaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagacccaataaaaaaaaaa

SEQ ID NO: 361 - DNA, 2176 bp, Homo sapiens
tgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttgagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagacccaataaaaaaaaaa

SEQ ID NO: 362 - DNA, 2898 bp, Homo sapiens
gggttggttccaagtctttgctattgtgaatagtgccgcaataaacatacgtgtgcatgtgtctttatagcagcatgatttatagtcctttgggtatatacccagtaatgggatggctgggttctagatccctgaggaatcgccacattgacttgcacaatggttgaactagtttacagtcccaccaacagtgtaaaagtgttcctatttctccacatcctctccggcacctgttgtttcctgactttttaatgattgccattctaactggtgtgagatgatatctcattgtggttttgatttgcatttctctgatggccagtgatggtgagcattttttcatgtgttttttggctgcataaatgtcttcttttgagaagtgtctgttcatgattttttttttagacaaagtattagatcagatatttttggggaaaaatgctttgtgattgcttgttttgaatggtgagcattgtattttgttttaagttgttttctggttgttattacagctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatatgtgtggatttgtgatagctcatcttttaggggttaaatatgctgtattttcaactggcctttggtatcctgctgaagtgggtgctcctgctccattagcatacgtcccagagtttaactcactcctcacagaccgcatgaacttgctgcaaaggatgaaaaataccggtgtttacctcatttccagattaggggtcagctttctggttcttcccaaatatgaaaggataatgcagaagtacaacctgctgccggagaagtccatgtatgatttggttcatgggtccagcctgtggatgctgtgtactgacgtagcactggaattcccaagacccactctgcctaatgttgtttatgtaggaggaatcctaaccaaaccagccagcccactaccagaagatctccaaagatgggtaaatggtgctaatgaacatggctttgtcttggtgtcttttggagctggtgtcaagtatctgtcagaagacattgctaacaaactggcaggagctctggggagattgcctcaaaaagtgatttggaggttttctggacccaaaccaaagaatctaggaaacaacactaaactcatagaatggttaccacaaaatgacctgcttgggcattcaaagattaaagccttcctgagccatggtggtttgaacagtatttttgaaactatgtatcatggtgtgcctgtagtgggaattccactctttggagaccattatgatactatgaccagagtacaggcaaaaggcatggggatattgctagaatggaagacagttactgaaaaagagctctatgaagcactagtgaaggttatcaataatcccagctaccgtcagagggctcagaagctttcggaaattcacaaggatcaacctggtcaccctgtcaatcgaactatctattggatagattatattattcgtcacaatggagcccatcacctacgtgccgctgtccatcagatctccttttgtcagtattttttactggatattgcctttgtgcttttgcttggtgctgccttgttatactttctcttgtcttgggtgacaaaatttatctacagaaaaatcaaaagtctgtggtctagaaataagcatagcacagttaatggacattaccacaatggaatcctcaatggcaagtacaaaagaaatggccatattaaacatgaaaagaaagtgaaatgagccaacagcccaggtgatagaaataaattggttcactcattgaatttttattgctattatttagtctaacagctactaaaagtaaaacatcagtaaacaattctaacatgcccttatgagatctactaatgaaattctgtggaattaagatggctgtaaaaagcacaaacctaaaatgcagaaatgtattttattcaaatactgatgtagagagttttggcactgaaccttttagaagccttaattatttaaatcaattcagtgactgtgtcagaccttagttttaaatcttgatatgtgcgtgtcccggatcaggaatggtttcatttttcttaataatgtgtgtgtgtgtatgtgtgtgtgtgtgtgtgtgtgtttgtgtgtgtgtgtgtgtgtcctaattaagagaatttttactggctgcttgttacatttgttgagggtacaacacactcaagaataaagtaaaaggatagtcaggatccagatgtttcttttctagcatttaatgtgtgtgaactcagaacactaccatgaaagaacacttccccccaaaactggatgcagaggaagaaaaaaaaaaaagaaatggcacagttttttgtatttttttttttagttattttttgttgttgttgtttgtattgtttttcttttctgatagagtatggccacttctgggggaaaaacatgtaattaagtaaatgtatacattggttttcacgttttacttttgttttcccactaccaataatttt

SEQ ID NO: 363 - DNA, 1966 bp, Homo sapiens
gcgggacacagtctcttctcctctgctcttctttgggcaggtctctgggtctcaaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggaaaccagaaggcagggctggtggtgtcctgggagcagtctggggagctagcatcacaaccctggttttcctctgtgtttgcttcatcttcagagtgaagactagaaggaagaaagcagcccagccagtgcaaaacacggatgatgtgaaccccgtcatggtctcaggctccaggggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctccaaatacagtaaccttctgagatattgagatttaggacttccaacatatgaattttagaagggaacaatttagcccataacactgtgtccaattcttttaaaattaatgtttttgttgtaaatggactatataaataccttcgtatatatggcagaccacaggacttctgtccaagagaactgagttcaactccatctatg

SEQ ID NO: 364 - DNA, 2073 bp, Homo sapiens
gcgggacacagtctcttctcctctgctcttctttgggcaggtctctgggtctcaaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctggatgttgaggcggccacctctttccaccccagatgctccacagaaagtggccatcagcatcttccaaggaaacagcgcagccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggaaaccagaaggcagggctggtggtgtcctgggagcagtctggggagctagcatcacaaccctggttttcctctgtgtttgcttcatcttcagggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctccaaatacagtaaccttctgagatattgagatttaggacttccaacatatgaattttagaagggaacaatttagcccataacactgtgtccaattcttttaaaattaatgtttttgttgtaaatggactatataaataccttcgtatatatggcagaccacaggacttctgtccaagagaactgagttcaactccatctatg

SEQ ID NO: 365 - DNA, 1913 bp, Homo sapiens
gcgggacacagtctcttctcctctgctcttctttgggcaggtctctgggtctcaaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctatgctccacagaaagtggccatcagcatcttccaaggaaacagcgcagccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctccaaatacagtaaccttctgagatattgagatttaggacttccaacatatgaattttagaagggaacaatttagcccataacactgtgtccaattcttttaaaattaatgtttttgttgtaaatggactatataaataccttcgtatatatggcagaccacaggacttctgtccaagagaactgagttcaactccatctatg

SEQ ID NO: 366 - DNA, 2074 bp, Homo sapiens
gcgggacacagtctcttctcctctgctcttctttgggcaggtctctgggtctcaaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggaaaccagaaggcagggctggtggtgtcctgggagcagtctggggagctagcatcacaaccctggttttcctctgtgtttgcttcatcttcagagtgaagactagaaggaagaaagcagcccagccagtgcaaaacacggatgatgtgaaccccgtcatggtctcaggctccaggggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctccaaatacagtaaccttctgagatattgagatttaggacttccaacatatgaattttagaagggaacaatttagcccataacactgtgtccaattcttttaaaattaatgtttttgttgtaaatggactatataaataccttcgtatatatggcagaccacaggacttctgtccaagagaactgagttcaactccatctatg

SEQ ID NO: 367 - DNA, 1946 bp, Homo sapiens
gcgggacacagtctcttctcctctgctcttctttgggcaggtctctgggtctcaaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctatgctccacagaaagtggccatcagcatcttccaaggaaacagcgcagccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctccaaatacagtaaccttctgagatattgagatttaggacttccaacatatgaattttagaagggaacaatttagcccataacactgtgtccaattcttttaaaattaatgtttttgttgtaaatggactatataaataccttcgtatatatggcagaccacaggacttctgtccaagagaactgagttcaactccatctatg

SEQ ID NO: 368 - DNA, 6637 bp, Homo sapiens
gctggtggcgcccgccagccggcccgggagaggggacttgagcgcttcgcggccggtgcgcagcgcggctccggccccgcagtctgtctgcaagtggccatccccgcccccgactcctgcggccggtgcgggagctgtcagctgcacgttgcgggggtaccggagaagccggggttgccttctcccggttctgtgcgctaaccccggagcccggccccggggaactagggagcgtctccggctgcacagcgctcaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacccatgcgtaagctacccaagtttaatttggtagctgaaatatctttttgcctcagacagctcttgaattgctcatacagaacaattctgctggtgctggagtctgaagaatattttcatttgcattttagtggttagggagaggatataagattaatggaatgtatatttttatataagacgtatacggcaccttcttgaaaaggaagcatttgaacttgttcctccctatagttctattgccttatatgcaaaattgtaccctgttgctcagagaaattattcataagagaaaagaattccaattaattaaatatcacaatagcatcccagagagacagtaggaaatttctccttagtgagagctgagtccttgagaagttaagagactgtttcctgcttcccaccccaccccgttttttgtccctccgtttgatcacctccctgttgagtatggaatgtcccagtttaatataaaacatacagtttattccacacagcagtttgactttgtaaaagtttagcaaaataactgattgttttggataactcaacatgtttttcttaaatgctgttttagtattttctacctcttaataagcaccatattttagatcttgtataaaaagttgccatctgccttatagacaaatgtagagaattgatgttcttgctttgtgttgtgttctggtaaagctttaagtgagtgtcttacccctttcctatactttcttgttatccatatcattcttttgtgagttttgcagcagtcttgaataatacagattataactactgaaaggggaaccttcgtctttttaaatgtgtcatttcacattacaataatatgtgtagtagttgaattgtgttatcaaagcatgtccaacttctgtccagatgacattaaaaccaaagcctaattgttaagcctcttattctaaagtccatagcaatgctatggaatatcaagtataatgatgtagtaaaaagatttctccagaaaacactttgagatacttaaagaaattcagagcatatcgaatgttatgaatgaagagtaaaataattacaggaaaagaatgcatgatttttcattgtcacaccaaataaccagttggacaatattgcattttcaaaatggagagttatttaaagtggatgtgtagccttctggaatctgcacgtgactggcattttaaaacaactcattaaatattggattcattttatcgagatgccaagatgaacacaatgtgaatatcatttccatttctaagcagttgaatgacacagtcagattctttggtgtatgctttgttctttccatctcaagcatttatccaaattctgctcacagacatgaggaagcaggctgtagatttaagggcactcaaggggaaaacaaatgtagtttccacagtgtgaggataaatgtagaatcgtggtaatattggctgttaaattggcctgctccagagactggctcaaaaaagaaagaagcaacgaaaacaaaatgcacagcctgaatggacgtagcactgtcatgtggcatttggaaaatctttaattatcctaatgttatttcacttgcccttatgctttattttagagtcccagggacaactggatgaaacattacgtctgtagtcatcttatttgagatgggggtgggaacgaattaaaatatgatagagaactatatgcagattttaaaatctagtcagtactagcatctataaagggcttttctgaaatttaaacagcttggtgatgcatcctgatattataagcttaaaactatcttgagggggaaatgacttcttttctccttctgtcccttttctcaaaagcatctttcccccaaatgtatgtctctaggacattttatagttttaagaggaagaaaacagaaacgtggcatcatttgggaagaaccaaggtagaatttaattttctggactttaaatctcctggttaaataatgctaatcactgtaccatttgagttacatgttttaacctcttttttttttctaattattccatccaaaatttctggtgaattacacagaaatttttggaaatgggactttgtgcaggtaaccaccctgcacttcaggtaatgttcctgtcacagctgtcgactaccccacgctgcaggaaatccattcagaaatgagctaacagtctccagtgtagcaggagagccagtcacttccctccccaggccccaaagcaccccaaggctggtattccttgagtcataggtattaataataaaagcctcaatgcagcttctccatgtagttcctctcctacaagccaggtggattctggtcctaactaaagagatgggagttcacctgagggcaagaagtacccaggatgcccaaacagccgcacaggtgtcctgtgcttcctgtgagacttcctgggggaaatatacaaactaatatattttttaatgtttacgtcatttacactgctgcttttctcatattctgcttttaattacttgtagtaaatcatttgtttgggcttcaagcactgtcttccatctgcatcttccagatttatcatgagtgatcttgttctactgttaaagatgtcaagcctaaaaagtaataaagtttttatttggctgttgaaccttgatgtagcccctactacatacactacaagttatgccttctggctactacagaatctccgcagaccttttagttatgagtagaagcaataagaaggtgtccttatggtcttaggaataatagttccaatgtattggcataatttgtttgaatgtctttattttgatattaacaccggcataaatctatttttgctaccagatgatagctattttcatttgctctattttcctctgcattgtactaatctgttactcagtgttagtcttcatttttctgtgttggaaacctgcgtcatgtaaatatctgcaaatcatgacagtctaaagtgcaaaccattttcagagactttggggaatgcagtgatcagaagtggctaatttattttatttctgattattttatccagagggtacttttttaatggatatttgtaaatcttccacttaaccactgaaaattattttgttttaatcccacccttccatccatacctctgcctccccaaaaagctcctattaatttgcttatccccctcatgtagctagttgaatgtgaataaataacatggaaaaaaaaaaaaaaaaaaaaaaaaa

SEQ ID NO: 369 - DNA, 6622 bp, Homo sapiens
gctggtggcgcccgccagccggcccgggagaggggacttgagcgcttcgcggccggtgcgcagcgcggctccggccccgcagtctgtctgcaagtggccatccccgcccccgactcctgcggccggtgcgggagctgtcagctgcacgttgcgggggtaccggagaagccggggttgccttctcccggttctgtgcgctaaccccggagcccggccccggggaactagggagcgtctccggctgcacagcgctcaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccagggtggatcttttgaaagtcccaaaaaggaaaaaagatcgcacaggaggtggcggtccagagctattggcaaagatgctaaaggaacactgcaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacccatgcgtaagctacccaagtttaatttggtagctgaaatatctttttgcctcagacagctcttgaattgctcatacagaacaattctgctggtgctggagtctgaagaatattttcatttgcattttagtggttagggagaggatataagattaatggaatgtatatttttatataagacgtatacggcaccttcttgaaaaggaagcatttgaacttgttcctccctatagttctattgccttatatgcaaaattgtaccctgttgctcagagaaattattcataagagaaaagaattccaattaattaaatatcacaatagcatcccagagagacagtaggaaatttctccttagtgagagctgagtccttgagaagttaagagactgtttcctgcttcccaccccaccccgttttttgtccctccgtttgatcacctccctgttgagtatggaatgtcccagtttaatataaaacatacagtttattccacacagcagtttgactttgtaaaagtttagcaaaataactgattgttttggataactcaacatgtttttcttaaatgctgttttagtattttctacctcttaataagcaccatattttagatcttgtataaaaagttgccatctgccttatagacaaatgtagagaattgatgttcttgctttgtgttgtgttctggtaaagctttaagtgagtgtcttacccctttcctatactttcttgttatccatatcattcttttgtgagttttgcagcagtcttgaataatacagattataactactgaaaggggaaccttcgtctttttaaatgtgtcatttcacattacaataatatgtgtagtagttgaattgtgttatcaaagcatgtccaacttctgtccagatgacattaaaaccaaagcctaattgttaagcctcttattctaaagtccatagcaatgctatggaatatcaagtataatgatgtagtaaaaagatttctccagaaaacactttgagatacttaaagaaattcagagcatatcgaatgttatgaatgaagagtaaaataattacaggaaaagaatgcatgatttttcattgtcacaccaaataaccagttggacaatattgcattttcaaaatggagagttatttaaagtggatgtgtagccttctggaatctgcacgtgactggcattttaaaacaactcattaaatattggattcattttatcgagatgccaagatgaacacaatgtgaatatcatttccatttctaagcagttgaatgacacagtcagattctttggtgtatgctttgttctttccatctcaagcatttatccaaattctgctcacagacatgaggaagcaggctgtagatttaagggcactcaaggggaaaacaaatgtagtttccacagtgtgaggataaatgtagaatcgtggtaatattggctgttaaattggcctgctccagagactggctcaaaaaagaaagaagcaacgaaaacaaaatgcacagcctgaatggacgtagcactgtcatgtggcatttggaaaatctttaattatcctaatgttatttcacttgcccttatgctttattttagagtcccagggacaactggatgaaacattacgtctgtagtcatcttatttgagatgggggtgggaacgaattaaaatatgatagagaactatatgcagattttaaaatctagtcagtactagcatctataaagggcttttctgaaatttaaacagcttggtgatgcatcctgatattataagcttaaaactatcttgagggggaaatgacttcttttctccttctgtcccttttctcaaaagcatctttcccccaaatgtatgtctctaggacattttatagttttaagaggaagaaaacagaaacgtggcatcatttgggaagaaccaaggtagaatttaattttctggactttaaatctcctggttaaataatgctaatcactgtaccatttgagttacatgttttaacctcttttttttttctaattattccatccaaaatttctggtgaattacacagaaatttttggaaatgggactttgtgcaggtaaccaccctgcacttcaggtaatgttcctgtcacagctgtcgactaccccacgctgcaggaaatccattcagaaatgagctaacagtctccagtgtagcaggagagccagtcacttccctccccaggccccaaagcaccccaaggctggtattccttgagtcataggtattaataataaaagcctcaatgcagcttctccatgtagttcctctcctacaagccaggtggattctggtcctaactaaagagatgggagttcacctgagggcaagaagtacccaggatgcccaaacagccgcacaggtgtcctgtgcttcctgtgagacttcctgggggaaatatacaaactaatatattttttaatgtttacgtcatttacactgctgcttttctcatattctgcttttaattacttgtagtaaatcatttgtttgggcttcaagcactgtcttccatctgcatcttccagatttatcatgagtgatcttgttctactgttaaagatgtcaagcctaaaaagtaataaagtttttatttggctgttgaaccttgatgtagcccctactacatacactacaagttatgccttctggctactacagaatctccgcagaccttttagttatgagtagaagcaataagaaggtgtccttatggtcttaggaataatagttccaatgtattggcataatttgtttgaatgtctttattttgatattaacaccggcataaatctatttttgctaccagatgatagctattttcatttgctctattttcctctgcattgtactaatctgttactcagtgttagtcttcatttttctgtgttggaaacctgcgtcatgtaaatatctgcaaatcatgacagtctaaagtgcaaaccattttcagagactttggggaatgcagtgatcagaagtggctaatttattttatttctgattattttatccagagggtacttttttaatggatatttgtaaatcttccacttaaccactgaaaattattttgttttaatcccacccttccatccatacctctgcctccccaaaaagctcctattaatttgcttatccccctcatgtagctagttgaatgtgaataaataacatggaaaaaaaaaaaaaaaaaaaaaaaaa

SEQ ID NO: 370 - DNA, 6529 bp, Homo sapiens
gctggtggcgcccgccagccggcccgggagaggggacttgagcgcttcgcggccggtgcgcagcgcggctccggccccgcagtctgtctgcaagtggccatccccgcccccgactcctgcggccggtgcgggagctgtcagctgcacgttgcgggggtaccggagaagccggggttgccttctcccggttctgtgcgctaaccccggagcccggccccggggaactagggagcgtctccggctgcacagcgctcaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacccatgcgtaagctacccaagtttaatttggtagctgaaatatctttttgcctcagacagctcttgaattgctcatacagaacaattctgctggtgctggagtctgaagaatattttcatttgcattttagtggttagggagaggatataagattaatggaatgtatatttttatataagacgtatacggcaccttcttgaaaaggaagcatttgaacttgttcctccctatagttctattgccttatatgcaaaattgtaccctgttgctcagagaaattattcataagagaaaagaattccaattaattaaatatcacaatagcatcccagagagacagtaggaaatttctccttagtgagagctgagtccttgagaagttaagagactgtttcctgcttcccaccccaccccgttttttgtccctccgtttgatcacctccctgttgagtatggaatgtcccagtttaatataaaacatacagtttattccacacagcagtttgactttgtaaaagtttagcaaaataactgattgttttggataactcaacatgtttttcttaaatgctgttttagtattttctacctcttaataagcaccatattttagatcttgtataaaaagttgccatctgccttatagacaaatgtagagaattgatgttcttgctttgtgttgtgttctggtaaagctttaagtgagtgtcttacccctttcctatactttcttgttatccatatcattcttttgtgagttttgcagcagtcttgaataatacagattataactactgaaaggggaaccttcgtctttttaaatgtgtcatttcacattacaataatatgtgtagtagttgaattgtgttatcaaagcatgtccaacttctgtccagatgacattaaaaccaaagcctaattgttaagcctcttattctaaagtccatagcaatgctatggaatatcaagtataatgatgtagtaaaaagatttctccagaaaacactttgagatacttaaagaaattcagagcatatcgaatgttatgaatgaagagtaaaataattacaggaaaagaatgcatgatttttcattgtcacaccaaataaccagttggacaatattgcattttcaaaatggagagttatttaaagtggatgtgtagccttctggaatctgcacgtgactggcattttaaaacaactcattaaatattggattcattttatcgagatgccaagatgaacacaatgtgaatatcatttccatttctaagcagttgaatgacacagtcagattctttggtgtatgctttgttctttccatctcaagcatttatccaaattctgctcacagacatgaggaagcaggctgtagatttaagggcactcaaggggaaaacaaatgtagtttccacagtgtgaggataaatgtagaatcgtggtaatattggctgttaaattggcctgctccagagactggctcaaaaaagaaagaagcaacgaaaacaaaatgcacagcctgaatggacgtagcactgtcatgtggcatttggaaaatctttaattatcctaatgttatttcacttgcccttatgctttattttagagtcccagggacaactggatgaaacattacgtctgtagtcatcttatttgagatgggggtgggaacgaattaaaatatgatagagaactatatgcagattttaaaatctagtcagtactagcatctataaagggcttttctgaaatttaaacagcttggtgatgcatcctgatattataagcttaaaactatcttgagggggaaatgacttcttttctccttctgtcccttttctcaaaagcatctttcccccaaatgtatgtctctaggacattttatagttttaagaggaagaaaacagaaacgtggcatcatttgggaagaaccaaggtagaatttaattttctggactttaaatctcctggttaaataatgctaatcactgtaccatttgagttacatgttttaacctcttttttttttctaattattccatccaaaatttctggtgaattacacagaaatttttggaaatgggactttgtgcaggtaaccaccctgcacttcaggtaatgttcctgtcacagctgtcgactaccccacgctgcaggaaatccattcagaaatgagctaacagtctccagtgtagcaggagagccagtcacttccctccccaggccccaaagcaccccaaggctggtattccttgagtcataggtattaataataaaagcctcaatgcagcttctccatgtagttcctctcctacaagccaggtggattctggtcctaactaaagagatgggagttcacctgagggcaagaagtacccaggatgcccaaacagccgcacaggtgtcctgtgcttcctgtgagacttcctgggggaaatatacaaactaatatattttttaatgtttacgtcatttacactgctgcttttctcatattctgcttttaattacttgtagtaaatcatttgtttgggcttcaagcactgtcttccatctgcatcttccagatttatcatgagtgatcttgttctactgttaaagatgtcaagcctaaaaagtaataaagtttttatttggctgttgaaccttgatgtagcccctactacatacactacaagttatgccttctggctactacagaatctccgcagaccttttagttatgagtagaagcaataagaaggtgtccttatggtcttaggaataatagttccaatgtattggcataatttgtttgaatgtctttattttgatattaacaccggcataaatctatttttgctaccagatgatagctattttcatttgctctattttcctctgcattgtactaatctgttactcagtgttagtcttcatttttctgtgttggaaacctgcgtcatgtaaatatctgcaaatcatgacagtctaaagtgcaaaccattttcagagactttggggaatgcagtgatcagaagtggctaatttattttatttctgattattttatccagagggtacttttttaatggatatttgtaaatcttccacttaaccactgaaaattattttgttttaatcccacccttccatccatacctctgcctccccaaaaagctcctattaatttgcttatccccctcatgtagctagttgaatgtgaataaataacatggaaaaaaaaaaaaaaaaaaaaaaaaa

SEQ ID NO: 371 - DNA, 3115 bp, Homo sapiens
ggccacgcgtgcttgagaaggttcaatggcgtggcagggactagcggccgagttcctgcaggtgccggcggtgacgcgggcttacaccgcagcctgtgtcctcaccaccgccgcggtgcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccctgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctggggattgcggtgggccatatctactacttcctggaggacgtcttccccaaccagcctggaggcaagaggctcctgcagacccctggcttcctaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgcagtctcttggcccacagcactggcttccccatctcacctggccacatccttctatgcctgccccgtcctcactcagtgtggcctctcagcccaactgcaggtggtaggataggggtgcccacagagggcaaagaaactgcccatggttgcctggcagagctttgagctcacaggttgccaggcagagcttttgagctcacaggtgacaggctcagggttctcatcctggccccaccagggccttgggcaagtcctgcccaccataggcctctgctacctgccagtcagcggggaagttcaccagatttcggctgctggggccaggacaggcgtctcctaggttgtgccaaaccagcctacagatgttcctgccagtggtgccttcaggctgatgccaatctagcctctcctgtctctcatcagccaccctgacaggtgggcgtatgcctcatttttcatctggtgatgccaaagccccatggattcaggtgcagaagagggccaggactaggtcttctgccctttctatgacctcagagcctaagttttcaccttagcagagttctgagactgggtgaggcagggacttctggaaggttctgttcctgccctttttagctgaggacgtgtgtgagccttatccgacccctgtggctcatttttctcttctgacctggcagctttccttgttgttctaagcctgtccatgttgtggtttatttctggatgctcagtggcacggggcctcctccaaagacaggttgtcattttcatggtaacaacactgttctctgttgagtctgccctccgtgttgtagccagaccttgtggagatggctttgcggcggtgtgagctggcggtcaggagtgagggcccagccttcccggcacctcccagccaggtggccctgcccgacctgtggggtgaggcagccaaggttccttccatccccccagttgtggagacacagggctgcctcaccctttcattgccgaggttcctacctcatggacagaacaaacacctcagcaatgaaacctgttcatgtctaagagcagctgggctgggaatcttcccctttgttcaaggccttccagtaaggcccagctgtccccttgctgtgcatggggctctggggagttccactctttgatggagggcagaggccctgagtgcaaactccctgggaagagtcccatgctaacatgtgctcaaaggagccctcctctcacatctcagcgaccaagaaccccaatccctaatcagagctctgcctctgccccacatggggccctaccccacttccagggagcacagcagcctctgaccctagccctgccctggcagcatgggacctgccaacagctgagggtggcagcagtctgtgctgggatctgtgcccggatctgtgcccattctcttcagtaaggctggagctgcgagccagtttgctgccctcccagatcctgtgtccattctgaagaatggggacacctccctattacagatgagaacagaggggacatgaactccttggaggcagggctgggaagggaccctgggctgtgtctcctccctgtaccgtgtcaactccaagagctggcaccaggccgggagggctattcccatattcctcacagctggcttgtaaggcaggagctggcccaggccacagcacctgctggggtgggaaagggccccagctgacctggctatgggtgccactggagctagaacagccctcctgcacccaggctggcgacagcccagcagtgcccacacaggactgggccctccgcaggggacttcagagcagcaaggccccagctggcagtagcctgaccatctggacacagcagagccagggcggcccagggacggcaggagagctcgcggcaccttcctgaggccaagcaaggggagcagggttagggctgttcctgaaaggcagagagcctcttgccctgagcctcacagctactcttctcagctctctgggtctggaaggagaacaggctgaggggagctgagaggagctgaggtgctacccggagccccattcacccccacctgcccacttgggaatctgaggcagaggagggtgaggcctgtgtgccaaccttgttcacataccaccttcgtccccccaggccccggccccactcctggctctcattatttttatgttaaaactttgaagaaattgaacatgacctgttgaagaaattgaaaaaaaaaaaaaaaaaa

SEQ ID NO: 372 - DNA, 3216 bp, Homo sapiens
ggccacgcgtgcttgagaaggttcaatggcgtggcagggactagcggccgagttcctgcaggtgccggcggtgacgcgggcttacaccgcagcctgtgtcctcaccaccgccgcggtgcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccctgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctggggattgcggtgggccatatctactacttcctggaggacgtcttccccaaccagcctggaggcaagaggctcctgcagacccctggcttcctgtgagtgttgagagccctccctccctctccccaccctcagaaggatccccaccgatggggacctgtgctggcctgtgctcaacacgggcccctccccacagaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgcagtctcttggcccacagcactggcttccccatctcacctggccacatccttctatgcctgccccgtcctcactcagtgtggcctctcagcccaactgcaggtggtaggataggggtgcccacagagggcaaagaaactgcccatggttgcctggcagagctttgagctcacaggttgccaggcagagcttttgagctcacaggtgacaggctcagggttctcatcctggccccaccagggccttgggcaagtcctgcccaccataggcctctgctacctgccagtcagcggggaagttcaccagatttcggctgctggggccaggacaggcgtctcctaggttgtgccaaaccagcctacagatgttcctgccagtggtgccttcaggctgatgccaatctagcctctcctgtctctcatcagccaccctgacaggtgggcgtatgcctcatttttcatctggtgatgccaaagccccatggattcaggtgcagaagagggccaggactaggtcttctgccctttctatgacctcagagcctaagttttcaccttagcagagttctgagactgggtgaggcagggacttctggaaggttctgttcctgccctttttagctgaggacgtgtgtgagccttatccgacccctgtggctcatttttctcttctgacctggcagctttccttgttgttctaagcctgtccatgttgtggtttatttctggatgctcagtggcacggggcctcctccaaagacaggttgtcattttcatggtaacaacactgttctctgttgagtctgccctccgtgttgtagccagaccttgtggagatggctttgcggcggtgtgagctggcggtcaggagtgagggcccagccttcccggcacctcccagccaggtggccctgcccgacctgtggggtgaggcagccaaggttccttccatccccccagttgtggagacacagggctgcctcaccctttcattgccgaggttcctacctcatggacagaacaaacacctcagcaatgaaacctgttcatgtctaagagcagctgggctgggaatcttcccctttgttcaaggccttccagtaaggcccagctgtccccttgctgtgcatggggctctggggagttccactctttgatggagggcagaggccctgagtgcaaactccctgggaagagtcccatgctaacatgtgctcaaaggagccctcctctcacatctcagcgaccaagaaccccaatccctaatcagagctctgcctctgccccacatggggccctaccccacttccagggagcacagcagcctctgaccctagccctgccctggcagcatgggacctgccaacagctgagggtggcagcagtctgtgctgggatctgtgcccggatctgtgcccattctcttcagtaaggctggagctgcgagccagtttgctgccctcccagatcctgtgtccattctgaagaatggggacacctccctattacagatgagaacagaggggacatgaactccttggaggcagggctgggaagggaccctgggctgtgtctcctccctgtaccgtgtcaactccaagagctggcaccaggccgggagggctattcccatattcctcacagctggcttgtaaggcaggagctggcccaggccacagcacctgctggggtgggaaagggccccagctgacctggctatgggtgccactggagctagaacagccctcctgcacccaggctggcgacagcccagcagtgcccacacaggactgggccctccgcaggggacttcagagcagcaaggccccagctggcagtagcctgaccatctggacacagcagagccagggcggcccagggacggcaggagagctcgcggcaccttcctgaggccaagcaaggggagcagggttagggctgttcctgaaaggcagagagcctcttgccctgagcctcacagctactcttctcagctctctgggtctggaaggagaacaggctgaggggagctgagaggagctgaggtgctacccggagccccattcacccccacctgcccacttgggaatctgaggcagaggagggtgaggcctgtgtgccaaccttgttcacataccaccttcgtccccccaggccccggccccactcctggctctcattatttttatgttaaaactttgaagaaattgaacatgacctgttgaagaaattgaaaaaaaaaaaaaaaaaa

SEQ ID NO: 373 - DNA, 4007 bp, Homo sapiens
atttaagggcccgcctctcctggctcacagctgcttgctgctccagccttgccctcccagagctgccggacgctcgcgggtctcggaacgcatcccgccgcgggggcttcggccgtggcatgggcgccgcgggcctgctcggggttttcttggctctcgtcgcaccgggggtcctcgggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtgttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctgtgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggcatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatcaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagcacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggctttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacatacaaaaaaaaaaaaaaaa

SEQ ID NO: 374 - DNA, 1437 bp, Homo sapiens
attgctgatggatcagtgagcctgtgttcatgccagtgagctgctgtggctcagatactgatactttctttccaaacagcataagaagtgattgagccacaagtatactgaaggaagggctccctcgagttctggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcgaatgtcactcttgtcgcccaagttggagtgcaatggcacaatctaggctcactgcaaccctgcaacctctgcctaccgggttcaagagattcccctgcctcagcctcccaagtagctggaattacaggcacctgccaccacatccagctaactttttttgtatttttactagagacagggtttcaccatgttggccacactggtctcaaactcctgacctcaggtgatccgcctgcctcggcccccaaagtgctgggattacaggcatgagccaccacatctggcctaggaccttaaatattggaaagcatcctcaaaactgtgggtcagtgagtagaactacaaaacaatagcagtagggcagaaacttgaaagaaggcaggagatcatggtgacagtggatgggaaaaagtgagggttggggataagggttgcgggttgtcgaagggtggattttctccttcagcaactacaggagatatgatgcctcataattcggagccagaagtggggctttgggtgagatatctttgcacagataacatgtatacatcatagttcaaaacccagtagtcattgtttacagcaaataaagaaatatttagtaaattaaaaaaaaaaaaaaaa

SEQ ID NO: 375 - DNA, 4083 bp, Homo sapiens
agcctcggggagcagcccgggctgtttgttccgtcaccggggaaaggaggtacacacagtcgcgcgcgcacggacacacacacacacgcacgcacgcacacacaccggtggcgagttcgagccccgcggcccctgtccgcccgcgtgcgcccctcgacacagctcgcctcccgccccctgattcctgctgctgccgcccagaggagaaaggaacctctgcctcgaatttccccactgcgccgggcgctgcggagagcggcgagggtgggcgcgaggcggagaacgcgatgaatgagttctcccctcgcctcggagttgtctgagttggcggcgctgcgcccaggcttccggctctcagcgccccacgcgcgcgtggctccccgggctgccacccacgcccgcggccggggccgagccagccacgcagggcagccgaggctccggagctcctgtcccggccccagtccgggtaaaaggagggttgtccccagcggaggcgcacagccgcgcgttctccctgcactctcttcgcggtcccatctgttccccatggcgtctcatccgcaaacccggatccaggcttacctggagaagaacaagatcggtcccctgtttgaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagcttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctgggtaattttaaaaattaataatttctcattttcttctttgacattgtaaaaaaaacgtgtggtgattaagagattttaaaagttttgaatagccttgtcttagggaaaagaaaccatttagtacatattttatttacattagactcacataaagttgcatgtaagaactaaattgaaataccctaagcatatgaatatttattagactgtattttgtgctttgtgtatgctgcactttaccttctgactacgtaatgaagcgttattctgtgtgcaactgtgatcaaaattcaagtctgtctgctttattctctgataataattgccttgtttacatctattgtctataaaatatacccaaagtacatatttcagccctcactccaaaatgtctaccttttattttgaggatgctttagaaaaatagaataaagttgaaaggggcagatagtaaattcaggttttatgttttccgtaaatgacgggaaagtttgcagagatttcaaagtttcttcaggcctgttactttcatgaaaccttattaatcttgtatatgtaggatatctttttatattttttaatgtagtatatgtatgtttttgcttcatcagaaatctcttcatataaatttttaaactgaacttctctttggaacatcatttttctgaagaaagaaaatgaaatgttatttcagagtgatccacatataaaacaatgagttttgaagtcagtggtatcaattattctgctacaaataaagagtatgattttcaaatactttataacaatatgctgttgtattttatttagaaagagaataaataatataattatttgaaagccttaaacacgttttacatatagaatatggaatctcagaaaaatataggccattttctgaagtttttgttaaaaatgagattccttggttttaagtgtttatggcagtaaaatactatcattataaaaaatgatatattgcttatcatttttgcataggcctacaaaggtgttatttggtcaatggtgacaggtttgaaagatgttttctgatgctgtaaaaactgcattcatgctaacattaaggagattgtatcatggcgttttcattacatgctgttggtcccttccaattgggtcttttcctcacctccaaatcattaacatggcagacgtgccctatgtggcagtggtagcttcattcaacaaacatttactgagcacttactctatgctaagcacttggctggggtctgggaacataaaaataaaatcattgtgatctgtgtttgaaggaattttacattgtaatgttcaagatacaatacgtcactacctgtgctaactgcgctaattggatgaagcacacagttgtgtataggggtaacacctaaagcagaggtaagggacagtgacccaggaatgtttcctagagaagccgattactctggctagtcctgaaaagcaaatagatgtaagctcagcaggtggggtgtggtcattgtaggtttgctcacgtaggtatgggctgttttgcgattgtgctccataactatacctgtaaatggttcctctgctttggacagtaacagggaaggggcaactgagatccagggtttctttcaggagatgcagttgtccactccatgctggtactccctagatctcagctgccctgactgaaggttctagtctcccaagctgaagaccgaggattgagtcttggagactatctaatgatgagcaattaataactagtcctcattaattctttttttagacattttagcctgtggtctgagcaagtttaataataagagatagttgaaggtttggactttcttcatgtaattccacatatctcagcacaggtggcaagcagtgtaataatgttggtctctaggtcatgagattatcctcttatagcttggaatgttacaagtccactggactttatcttaaaataatgccatattcaatttcttgtttttgaaatggattccagcaaaatgtatgtgattgtgtctatttcagaaaaatataaatgctaagttcttggaaatttatgtgaaatctaattttatagagtttatatagaatcattgtaagatgcaatagagacatctggtatttaaaatctttttgaatctacattttgtagatgtgtgtgctatagcttatgtgtttgtaaatgtttaacttgtctttgttatctataccaagatataactggctgaaaaatatttattatgcatggaaagcactctgtaaaccttgtgaagtgataaataagtgaaaggtataattgttagttgacattaatataaaaaaggattattcttcaataaaattggttgatttgaagggaaaaaatccttttagttgaactagtagaagttagtaataactattgactcttgttttgtttattaaggaaactagcattgttaatatatactgattaatatttaattattcacagttgtttaattatatatttgtggatttcttttctaaatgttttaggcatatgaaaatattatagtacaacacctgtaatttttaagtagatcaaatattttctgtaagattgctttaaatgctccttataaattcacattgcaaaagtaacttaatatggaattaacacttgtcagataataaaacagccaaacttgtaaaaaaaaa

SEQ ID NO: 376 - DNA, 4010 bp, Homo sapiens
attggttgcggcggatgcctcgcgggccggtggctatggaggcggcggcggttgatggttgaccgttggctccggggtgggggtcgccgttcgagtgatctgctcagacccgaccagagggcgcgggctgctgatgcttggcttggagcccgtgggggagacctagttcggctccgccatgccggccgccgggagtaacgagccggacggcgtcctcagctatcagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtacgctccatggtgagtgactttgctgttttcctcactatcttcacaatggtgattattgattttttgattggagtcccatcaccaaagcttcaagttcccagtgtgttcaagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagtttattccaatgccagtactctacggagttttcctttacatgggagtttcttcactacagggaattcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcatgcctgaaagcaaaaagaagaagttggatgatgccaaaaagaaggccaaggaggaagaggtcatagtccttgcaccaactgtatacctgggggcctcaaattacagaacataggaagggtcatgtgaaaagtcagcatgtctggaatcccgagggttatatttaggagctgggaagattacccccaaagatgttctcagctaagaatggattagggattcttgcttctgtctgttcttaatttttgggtttgacaaccacttattttttcctttgtttacaatctactcaccaggctcatacctacaatgtgaacatacagtatgcccttattagcagattcaatggctcacattctttcaaaaggtctaatttgacaaatacataagacccattatttcctagaatgtttgtaatatatctaattgcaaatggtgctgtggttggcaccatgcaaagataacttgcataggactttctgtcttttttcatttccctcagcacttggcatcttgtcatctacacaatggaccctcaataaatggcctatatgtgcaaagaaagaatgtgtagcaaatgaaaataccagaccaagaaatgagtgagctgggaagtgtttccaaatacagttagtgcctaaaatagtgtcctttgaaaaaacttttaaaagacttttttttaggccaggcataatgggttatccctgtaattccagggcttttgggagttgaagctggaggattacttgaggccagaagtttgagactagcctaggcaatataatgagaccctgtctctacaaaaaaaaaaa

SEQ ID NO: 377 - DNA, 2233 bp, Homo sapiens
gctgagcaggagatgggaattgaaacctgcgcagaggcggctgtgcagggtgagagtggagccgaaaccacagaaagtgaagtttgcttcaacgtcttgtcccggcaggccactcagatgtgagagtgaggaagtgggatggggcctgaccggaaggaggtgcccctgagccgaggaacgcaggcggtggtcgtggggaagggaagaggagccccgggagacgacagcagcatgggtgggcggccttcgagccctctggacaagcagcagcggcagcacctaaggggtcaggtggacaccctgctgaggaacttcctgccttgctaccgtgggcagctggcagcgtctgtcctgcggcagatctctcgagagctgggccctcaggagccgaccggaagccagttgctacgcagcaaaaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcacagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaagaaattcaaatcggacagcgggttggcgcagaggaggttcatccgaggctggggtctctgcatctttttaccttttgtgctgagccaactcgagccaggctgcaaaaaggagctgcctgagttcgagggggatgtccttgccgtgggcagccaggctctgaccactgagggcatctatgaggacgtcatccgggggtgcttgctgcagaggattgaccaagaattgaaaaagacccttggtgccaatgatgtatcctgcactctggacggctgcttggaggtcccatgggaacaggagggagcagatgaggaaactgaggctgagcgggaaggaggggcttgtcccaggcagccagactctggtgcccagatccagccactctgcccaccgccttctccaggaacattccggagctgaatcttcacccacatctatcttgtttctattggataaatgtctacaagtggaatttctgggccaaaacggatgtgccatctttaggcttttgtaacccctgcaacttcagaaaactgtaccattttataaaaaaaaaaaa

SEQ ID NO: 378 - DNA, 1437 bp, Homo sapiens; identical to SEQ ID NO: 374

SEQ ID NO: 379 - protein, 801 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTQENPIYKSPINNFKNPNYGRKAGL

SEQ ID NO: 380 - protein, 798 aa, Homo sapiens; identical to SEQ ID NO: 128

SEQ ID NO: 381 - protein, 619 aa, Homo sapiens
MSGIKKQKTENQQKSTNVVYQAHHVSRNKRGQVVGTRGGFRGCTVWLTGLSGAGKTTISFALEEYLVSHAIPCYSLDGDNVRHGLNRNLGFSPGDREENIRRIAEVAKLFADAGLVCITSFISPFAKDRENARKIHESAGLPFFEIFVDAPLNICESRDVKGLYKRARAGEIKGFTGIDSDYEKPETPERVLKTNLSTVSDCVHQVVELLQEQNIVPYTIIKDIHELFVPENKLDHVRAEAETLPSLSITKLDLQWVQVLSEGWATPLKGFMREKEYLQVMHFDTLLDGMALPDGVINMSIPIVLPVSAEDKTRLEGCSKFVLAHGGRRVAILRDAEFYEHRKEERCSRVWGTTCTKHPHIKMVMESGDWLVGGDLQVLEKIRWNDGLDQYRLTPLELKQKCKEMNADAVFAFQLRNPVHNGHALLMQDTRRRLLERGYKHPVLLLHPLGGWTKDDDVPLDWRMKQHAAVLEEGVLDPKSTIVAIFPSPMLYAGPTEVQWHCRSRMIAGANFYIVGRDPAGMPHPETKKDLYEPTHGGKVLSMAPGLTSVEIIPFRVAAYNKAKKAMDFYDPARHNEFDFISGTRMRKLAREGENPPDGFMAPKAWKVLTDYYRSLEKN

SEQ ID NO: 382 - protein, 563 aa, Homo sapiens
MRDPLTDCPYNKVYKNLKEFSQNGENFCKQVTSVLQQRANLEISYAKGLQKLASKLSKALQNTRKSCVSSAWAWASEGMKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQVTHSICLYAFWVKRAWGKCVSDLRYQDTFLPGNLPPLWFGYDIVKRLIMRLCSVCLQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGLERMLKTYSSTSSFSDAKSQKDTAALMDENNLKLDLLEANSYKLSSMLAELEQRPQPSHPCSNSIFRWREKEHTHSYVKISRPFLMKRLENIVSKASSGGQSNPGSSTPAPGAAQLSSRLCKALYSFQARQDDELNLEKGDIVIIHEKKEGGWWFGSLNGKKGHFPAAYVEELPSNAGNTATKA

SEQ ID NO: 383 - protein, 478 aa, Homo sapiens
MRDPLTDCPYNKVYKNLKEFSQNGENFCKQVTSVLQQSCVSSAWAWASEGMKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGLERMLKTYSSTSSFSDAKSQKDTAALMDENNLKLDLLEANSYKLSSMLAELEQRPQPSHPCSNSIFRWREKEHTHSYVKISRPFLMKRLENIVSKASSGGQSNPGSSTPAPGAAQLSSRLCKALYSFQARQDDELNLEKGDIVIIHEKKEGGWWFGSLNGKKGHFPAAYVEELPSNAGNTATKA

SEQ ID NO: 384 - protein, 428 aa, Homo sapiens
MKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGLERMLKTYSSTSSFSDAKSQKDTAALMDENNLKLDLLEANSYKLSSMLAELEQRPQPSHPCSNSIFRWREKEHTHSYVKISRPFLMKRLENIVSKASSGGQSNPGSSTPAPGAAQLSSRLCKALYSFQARQDDELNLEKGDIVIIHEKKEGGWWFGSLNGKKGHFPAAYVEELPSNAGNTATKA

SEQ ID NO: 385 - protein, 345 aa, Homo sapiens
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGAVNGFDPAPPPPGLGSSRPSSAPGMLPLSV

SEQ ID NO: 386 - protein, 687 aa, Homo sapiens
MLEPSSVLHANVNQAPLWCLVLRWCRECKDTVCGGKQKSRVNHTFQRREIEAKEACDWLRAAGFPQYAQLYEDSQFPINIVAVKNDHDFLEKDLVEPLCRRLNTLNKCASMKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQE

SEQ ID NO: 387 - protein, 646 aa, Homo sapiens
MKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQVGLFRKSGVKSRIHALRQMNENFPENVNYEDQSAYDVADMVKQFFRDLPEPLFTNKLSETFLHIYQCKWK

SEQ ID NO: 388 - protein, 1078 aa, Homo sapiens
MSTGTQPKTKVLSDNRPKERVEIEAKEACDWLRAAGFPQYAQLYEDSQFPINIVAVKNDHDFLEKDLVEPLCRRLNTLNKCASMKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQVGLFRKSGVKSRIHALRQMNENFPENVNYEDQSAYDVADMVKQFFRDLPEPLFTNKLSETFLHIYQYVSKEQRLQAVQAAILLLADENREVLQTLLCFLNDVVNLVEENQMTPMNLAVCLAPSLFHLNLLKKESSPRVIQKKYATGKPDQKDLNENLAAAQGLAHMIMECDRLFEVPHELVAQSRNSYVEAEIHVPTLEELGTQLEESGATFHTYLNHLIQGLQKEAKEKFKGWVTCSSTDNTDLAFKKVGDGNPLKLWKASVEVEAPPSVVLNRVLRERHLWDEDFVQWKVVETLDRQTEIYQYVLNSMAPHPSRDFVVLRTWKTDLPKGMCTLVSLSVEHEEAQLLGGVRAVVMDSQYLIEPCGSGKSRLTHICRIDLKGHSPEWYSKGFGHLCAAEVARIRNSFQPLIAEGPETKI

SEQ ID NO: 389 - protein, 995 aa, Homo sapiens
MKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQVGLFRKSGVKSRIHALRQMNENFPENVNYEDQSAYDVADMVKQFFRDLPEPLFTNKLSETFLHIYQYVSKEQRLQAVQAAILLLADENREVLQTLLCFLNDVVNLVEENQMTPMNLAVCLAPSLFHLNLLKKESSPRVIQKKYATGKPDQKDLNENLAAAQGLAHMIMECDRLFEVPHELVAQSRNSYVEAEIHVPTLEELGTQLEESGATFHTYLNHLIQGLQKEAKEKFKGWVTCSSTDNTDLAFKKVGDGNPLKLWKASVEVEAPPSVVLNRVLRERHLWDEDFVQWKVVETLDRQTEIYQYVLNSMAPHPSRDFVVLRTWKTDLPKGMCTLVSLSVEHEEAQLLGGVRAVVMDSQYLIEPCGSGKSRLTHICRIDLKGHSPEWYSKGFGHLCAAEVARIRNSFQPLIAEGPETKI

SEQ ID NO: 390 - protein, 1105 aa, Homo sapiens
MLEPSSVLHANVNQAPLWCLVLRWCRECKDTVCGGKQKSRVNHTFQRREIEAKEACDWLRAAGFPQYAQLYEDSQFPINIVAVKNDHDFLEKDLVEPLCRRLNTLNKCASMKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQVGLFRKSGVKSRIHALRQMNENFPENVNYEDQSAYDVADMVKQFFRDLPEPLFTNKLSETFLHIYQYVSKEQRLQAVQAAILLLADENREVLQTLLCFLNDVVNLVEENQMTPMNLAVCLAPSLFHLNLLKKESSPRVIQKKYATGKPDQKDLNENLAAAQGLAHMIMECDRLFEVPHELVAQSRNSYVEAEIHVPTLEELGTQLEESGATFHTYLNHLIQGLQKEAKEKFKGWVTCSSTDNTDLAFKKVGDGNPLKLWKASVEVEAPPSVVLNRVLRERHLWDEDFVQWKVVETLDRQTEIYQYVLNSMAPHPSRDFVVLRTWKTDLPKGMCTLVSLSVEHEEAQLLGGVRAVVMDSQYLIEPCGSGKSRLTHICRIDLKGHSPEWYSKGFGHLCAAEVARIRNSFQPLIAEGPETKI

SEQ ID NO: 391 - protein, 834 aa, Homo sapiens
MWTRNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVITPVRTGHGYVYEYPSRYQKDVYDIPPSHTTQGVYDIPPSSAKGPVFSVPVGEIKPQGVYDIPPTKGVYAIPPSACRDEAGLREKDYDFPPPMRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAKGSRDLVDGINRLSFSSTGSTRSNMSTSSTSSKESSLSASPAQDKRLFLDPDTAIERLQRLQQALEMGVSSLMALVTTDWRCYGYMERHINEIRTAVDKVELFLKEYLHFVKGAVANAACLPELILHNKMKRELQRVEDSHQILSQTSHDLNECSWSLNILAINKPQNKCDDLDRFVMVAKTVPDDAKQLTTTINTNAEALFRPGPGSLHLKNGPESIMNSTEYPHGGSQGQLLHPGDHKAQAHNKALPPGLSKEQAPDCSSSDGSERSWMDDYDYVHLQGKEEFERQQKELLEKENIMKQNKMQLEHHQLSQFQLLEQEITKPVENDISKWKPSQSLPTTNSGVSAQDRQLLCFYYDQCETHFISLLNAIDALFSCVSSAQPPRIFVAHSKFVILSAHKLVFIGDTLTRQVTAQDIRNKVMNSSNQLCEQLKTIVMATKMAALHYPSTTALQEMVHQVTDLSRNAQLFKRSLLEMATF

SEQ ID NO: 392 - protein, 174 aa, Homo sapiens
MKYKNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVFQRDGQVSYFLVRASKQTSL

SEQ ID NO: 393 - protein, 308 aa, Homo sapiens; identical to SEQ ID NO: 135

SEQ ID NO: 394 - protein, 442 aa, Homo sapiens; identical to SEQ ID NO: 136

SEQ ID NO: 395 - protein, 532 aa, Homo sapiens
MNKSTCLMAAETPSKRWRLHCLAFSQRFVRAGPACSSREACSSPRAGWNPAGFRLPGRWSPFVALHLVCQIREALKLRSGHRTPSGAGSSMQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 396 - protein, 436 aa, Homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKAGPHVGNKLVMLFSVNIECDGTVNQNPTMWPERKSNNN

SEQ ID NO: 397 - protein, 123 aa, Homo sapiens
MAEKRHTRDSEAQRLPDSFKDSPSKGLGPCGWILVAFSFLFTVITFPISIWMCIKVIAAEGEMNASRALKEASMVITESPAALQLRYLQTLTTIAAEKNSTIVFPLPIDMLQGIIGAKHSHLG

SEQ ID NO: 398 - protein, 1383 aa, Homo sapiens
MYATDSRGHSPAFLQPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEGVSLSGFRVEVVDGVKLNLLDDVSSWKPGDQIVVASTDYSMYQAEEFTLLPCSECSHFQVKVKETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSRCITVHGTNGLLIKDTIGFDTLGHCFFLEDGIEQRNTLFHNLGLLTKPGTLLPTDRNNSMCTTMRDKVFGNYIPVPATDCMAVSTFWIAHPNNNLINNAAAGSQDAGIWYLFHKEPTGESSGLQLLAKPELTPLGIFYNNRVHSNFKAGLFIDKGVKTTNSSAADPREYLCLDNSARFRPHQDANPEKPRVAALIDRLIAFKNNDNGAWVRGGDIIVQNSAFADNGIGLTFASDGSFPSDEGSSQEVSESLFVGESRNYGFQGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 399 - protein, 478 aa, Homo sapiens
MMNFLRRRLSDSSFIANLPNGYMTDLQRPEPQQPPPPPPPGPGAASASAAPPTASPGPERRPPPASAPAPQPAPTPSVGSSFFSSLSQAVKQTAASAGLVDAPAPAPAAARKAKVLLVVDEPHADWAKCFRGKKVLGDYDIKVEQAEFSELNLVAHADGTYAVDMQVLRNGTKVVRSFRPDFVLIRQHAFGMAENEDFRHLIIGMQYAGLPSINSLESIYNFCDKPWVFAQLVAIYKTLGGEKFPLIEQTYYPNHKEMLTLPTFPVVVKIGHAHSGMGKVKVENHYDFQDIASVVALTQTYATAEPFIDSKYDIRVQKIGNNYKAYMRTSISGNWKTNTGSAMLEQIAMSDRYKLWVDTCSEMFGGLDICAVKAVHGKDGKDYIFEVMDCSMPLIGEHQVEDRQLITELVISKMNQLLSRTPALSPQRPLTTQQPQSGTLKDPDSSKTPPQRPPPQGCLQYILDCNGIAVGPKQVQAS

SEQ ID NO: 400 - protein, 199 aa, Homo sapiens
MDGQKKNWKDKVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 401 - protein, 373 aa, Homo sapiens
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 402 - protein, 392 aa, Homo sapiens
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVDETLFALPAASEPVIRSSAVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 403 - protein, 986 aa, Homo sapiens
MDLKEQPGNTISAGQEDFPSVLLETAASLPSLSPLSAASFKEHEYLGNLSTVLPTEGTLQENVSEASKEVSEKAKTLLIDRDLTEFSELEYSEMGSSFSVSPKAESAVIVANPREEIIVKNKDEEEKLVSNNILHNQQELPTALTKLVKEDEVVSSEKAKDSFNEKRVAVEAPMREEYADFKPFERVWEVKDSKEDSDMLAAGGKIESNLESKVDKKCFADSLEQTNHEKDSESSNDDTSFPSTPEGIKDRSGAYITCAPFNPAATESIATNIFPLLGDPTSENKTDEKKIEEKKAQIVTEKNTSTKTSNPFLVAAQDSETDYVTTDNLTKVTEEVVANMPEGLTPDLVQEACESELNEVTGTKIAYETKMDLVQTSEVMQESLYPAAQLCPSFEESEATPSPVLPDIVMEAPLNSAVPSAGASVIQPSSSPLEASSVNYESIKHEPENPPPYEEAMSVSLKKVSGIKEEIKEPENINAALQETEAPYISIACDLIKETKLSAEPAPDFSDYSEMAKVEQPVPDHSELVEDSSPDSEPVDLFSDDSIPDVPQKQDETVMLVKESLTETSFESMIEYENKEKLSALPPEGGKPYLESFKLSLDNTKDTLLPDEVSTLSKKEKIPLQMEELSTAVYSNDDLFISKEAQIRETETFSDSSPIEIIDEFPTLISSKTDSFSKLAREYTDLEVSHKSEIANAPDGAGSLPCTELPHDLSLKNIQPKVEEKISFSDDFSKNGSATSKVLLLPPDVSALATQAEIESIVKPKVLVKEAEKKLPSDTEKEDRSPSAIFSAELSKTSVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 404 - protein, 288 aa, Homo sapiens
MDLLWILPSLWLLLLGGPACLKTQEHPSCPGPRELEASKVVLLPSCPGAPGSPGEKGAPGPQGPPGPPGKMGPKGEPGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 405 - protein, 503 aa, Homo sapiens; identical to SEQ ID NO: 148

SEQ ID NO: 406 - protein, 526 aa, Homo sapiens
MRCALALSALLLLLSTPPLLPSSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLPSSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 407 - protein, 395 aa, Homo sapiens
MAFSPWQILSPVQWAKWTWSAVRGGAAGEDEAGGPEGDPEEEDSQAETKSLSFRSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 408 - protein, 805 aa, Homo sapiens
MAFSPWQILSPVQWAKWTWSAVRGGAAGEDEAGGPEGDPEEEDSQAETKSLSFSSDSEGNFETPEAETPIRSPFKESCDPSLGLAGPGAKSQESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 409 - protein, 625 aa, Homo sapiens
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTREYPRPPQ

SEQ ID NO: 410 - protein, 377 aa, Homo sapiens; identical to SEQ ID NO: 157

SEQ ID NO: 411 - protein, 391 aa, Homo sapiens
MLRPGGAEEAAQLPLRRASAPVPVPSPAAPDGSRASARLGLACLLLLLLLTLPARVDTSWWYIGALGARVICDNIPGLVSRQRQLCQRYPDIMRSVGEGAREWIRECQHQFRHHRWNCTTLDRDHTVFGRVMLRSSREAAFVYAISSAGVVHAITRACSQGELSVCSCDPYTRGRHHDQRGDFDWGGCSDNIHYGVRFAKAFVDAKEKRLKDARALMNLHNNRCGRTAVRRFLKLECKCHGVSGSCTLRTCWRALSDFRRTGDYLRRRYDGAVQVMATQDGANFTAARQGYRRATRTDLVYFDNSPDYCVLDKAAGSLGTAGRVCSKTSKGTDGCEIMCCGRGYDTTRVTRVTQCECKFHWCCAVRCKECRNTVDVHTCKAPKKAEWLDQT

SEQ ID NO: 412 - protein, 1319 aa, Homo sapiens
MDALNRNQIGPGCQTQTMVQKGPLDLIETGKGLKVQTDKPHLVSLGSGRLSTAITLLPLEEGRTVIGSAARDISLQGPGLAPEHCYIENLRGTLTLYPCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKEAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKEVYRSKMDGEATSPLPRTRSGPLPSSSGSSSSSSQLSVATLGRSPSPKSALLTQNGTGSLPRNLAATLQDIETKRQLALQQKGQQVIEEQRRRLAELKQKAAAEAQCQWDALHGAAPFPAGPSGFPPLMHHSILHHLPAGRERGEEGEHAYDTLSLESSDSMETSISTGGNSACSPDNMSSASGLDMGKIEEMEKMLKEAHAEKNRLMESREREMELRRQALEEERRRREQVERRLQSESARRQQLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYDHLRSAAKSPNPALTFCVKTHDRLYYMVAPSAEAMRIWMDVIVTGAEGYTQFMN

SEQ ID NO: 413 - protein, 1377 aa, Homo sapiens; identical to SEQ ID NO: 163

SEQ ID NO: 414 - protein, 235 aa, Homo sapiens
MSRMGKPIETQKSPPPPYSRLSPRDEYKPLDLSDSTLSYTETEATNSLITAPGEFSDASMSPDATKPSHWCSVAYWEHRTRVGRLYAVYDQAVSIFYDLPQGSGFCLGQLNLEQRSESVRRTRSKIGFGILLSKEPDGVWAYNRGEHPIFVNSPTLDAPGGRALVVRKVPPGYSIKVFDFERSGLQHAPEPDAADGPYDPNSVRISFAKGWGPCYSRQFITSCPCWLEILLNNPR

SEQ ID NO: 415 - protein, 1076 aa, Homo sapiens; identical to SEQ ID NO: 168

SEQ ID NO: 416 - protein, 1165 aa, Homo sapiens
MYFLSGWPKRLLCPLGSPAEAPFHVQSDPQRAFFAVLAAARLSIWYSRPSVLIVTYKEPAKSSTQFGSYKQAEWRPDSTMIAVSTANGYILFFHITSTRGDKYLYEPVYPKGSPQMKGTPHFKEEQCAPALNLEMRKILDLQAPIMSLQSVLEDLLVATSDGLLHLIHWEGMTNGRKAINLCTVPFSVDLQSSRVGSFLGFTDVHIRDMEYCATLDGFAVVFNDGKVGFITPVSSRFTAEQLHGVWPQDVVDGTCVAVNNKYRLMAFGCVSGSVQVYTIDNSTGAMLLSHKLELTAKQYPDIWNKTGAVKLMRWSPDNSVVIVTWEYGGLSLWSVFGAQLICTLGGDFAYRSDGTKKDPLKINSMSWGAEGYHLWVISGFGSQNTEIESDLRSVVKQPSILLFQFIKSVLTVNPCMSNQEQVLLQGEDRLYLNCGEASQTQNPRSSSTHSEHKPSREKSPFADGGLESQGLSTLLGHRHWHVVQISSTYLESNWPIRFSAIDKLGQNIAVVGKFGFAHYSLLTKKWKLFGNITQEQNMIVTGGLAWWNDFMVLACYNINDRQEELRVYLRTSNLDNAFAHVTKAQAETLLLSVFQDMVIVFRADCSICLYSIERKSDGPNTTAGIQVLQEVSMSRYIPHPFLVVSVTLTSVSTENGITLKMPQQARGAESIMLNLAGQLIMMQRDRSGPQIREKDSNPNNQRKLLPFCPPVVLAQSVENVWTTCRANKQKRHLLEALWLSCGGAGMKVWLPLFPRDHRKPHSFLSQRIMLPFHINIYPLAVLFEDALVLGAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQNMEVPAVSRQHATLLFNTALEQGKWDLCRHMIRFLKAIGSGESETPPSTPTAQEPSSSGGFEFFRNRSISLSQSAENVPASKFSLQKTLSMPSGPSGKRWSKDSDCAENMYIDMMLWRHARRLLEDVRLKDLGCFAAQLGFELISWLCKERTRAARVDNFVIALKRLHKDFLWPLPIIPASSISSPFKNGKYRTGNVDFMSLVQGELYFTPCIYTFCY

SEQ ID NO: 417 - protein, 1386 aa, Homo sapiens
MYFLSGWPKRLLCPLGSPAEAPFHVQSDPQRAFFAVLAAARLSIWYSRPSVLIVTYKEPAKSSTQFGSYKQAEWRPDSTMIAVSTANGYILFFHITSTRGDKYLYEPVYPKGSPQMKGTPHFKEEQCAPALNLEMRKILDLQAPIMSLQSVLEDLLVATSDGLLHLIHWEGMTNGRKAINLCTVPFSVDLQSSRVGSFLGFTDVHIRDMEYCATLDGFAVVFNDGKVGFITPVSSRFTAEQLHGVWPQDVVDGTCVAVNNKYRLMAFGCVSGSVQVYTIDNSTGAMLLSHKLELTAKQYPDIWNKTGAVKLMRWSPDNSVVIVTWEYGGLSLWSVFGAQLICTLGGDFAYRSDGTKKDPLKINSMSWGAEGYHLWVISGFGSQNTEIESDLRSVVKQPSILLFQFIKSVLTVNPCMSNQEQVLLQGEDRLYLNCGEASQTQNPRSSSTHSEHKPSREKSPFADGGLESQGLSTLLGHRHWHVVQISSTYLESNWPIREQNMIVTGGLAWWNDFMVLACYNINDRQEELRVYLRTSNLDNAFAHVTKAQAETLLLSVFQDMVIVFRADCSICLYSIERKSDGPNTTAGIQVLQEVSMSRYIPHPFLVVSVTLTSVSTENGITLKMPQQARGAESIMLNLAGQLIMMQRDRSGPQIREKDSNPNNQRKLLPFCPPVVLAQSVENVWTTCRANKQKRHLLEALWLSCGGAGMKVWLPLFPRDHRKPHSFLSQRIMLPFHINIYPLAVLFEDALVLGAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQNMEVPAVSRQHATLLFNTALEQGKWDLCRHMIRFLKAIGSGESETPPSTPTAQEPSSSGGFEFFRNRSISLSQSAENVPASKFSLQKTLSMPSGPSGKRWSKDSDCAENMYIDMMLWRHARRLLEDVRLKDLGCFAAQLGFELISWLCKERTRAARVDNFVIALKRLHKDFLWPLPIIPASSISSPFKNGKYRTVGEQLLKSQSADPFLNLEMDAGISNIQRSQSWLSNIGPTHHEIDTASSHGPQMQDAFLSPLSNKGDECSIGSATDLTESSSMVDGDWTMVDENFSTLSLTQSELEHISMELASKGPHKSQVQLRYLLHIFMEAGCLDWCIVIGLILRESSIINQILVITQSSEVDGEMLQNIKTGLHAVDRWASTDCPGYKPFLNIIKPQLQKLSEITEEQVQPDAFQPITMGKTPEQTSPRAEESRGSSSHGSIPQGEVGSSNMVSRKEEDTAQAEEEEPFQDGTYDCSVS

SEQ ID NO: 418 - protein, 490 aa, Homo sapiens
MNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAVAQMLSGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 419 - protein, 488 aa, Homo sapiens
MNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAGTINSMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 420 - protein, 521 aa, Homo sapiens
MTSAFKLDFLPDMMVEGRLLVPDRINGTANKMNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAVAQMLSGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 421 - protein, 572 aa, Homo sapiens
MSYQGKKSIPHITSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 422 - protein, 193 aa, Homo sapiens; identical to SEQ ID NO: 175

SEQ ID NO: 423 - protein, 480 aa, Homo sapiens
MDDLQSQNLSMDMTDSPPALANNRLENGMAQLITTEAWNINSTDLVEGSSAPELNPNGNATYVMTTQGPVQLPVVLEQHVFQHLNSPLVLPQEAPCSSSTIHNNLFQGAEDPEAQPQLLDLRIPSQPQEPTLPFEAVLQNLFPSQGTLGPPPCQPPPGYAPVPPQPFSSPLSPLVPPATLLVPYPVIVPLPVPVPIPIPIPVPQSSESKFSSSFPKPPSSFGLHPFKGTQTPLEKDELKPFDILQPKEYFQLSRHTVIKMGSENEALDLSMKSVPWLKAGEVSPPIFQEDAALDLSVAAHRKSEPPPETLYDSGASVDSSGHTVMEKLPSGMEISFAPATSHEAPAMMDSHISSSDAATEMLSQPNHPSGEVKAENNIEMVGESQAAKVIVSVEDAVPTIFCGKIKGLSGVSTKNFSFKREDSVLQGYDINSQGEESMGNAEPLRKPIKNRSIKLKKVNSQEIHMLPIKKQRLATFFPRK

SEQ ID NO: 424 - protein, 530 aa, Homo sapiens; identical to SEQ ID NO: 178

SEQ ID NO: 425 - protein, 530 aa, Homo sapiens; identical to SEQ ID NO: 178

SEQ ID NO: 426 - protein, 319 aa, Homo sapiens
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGMAFPTKG

SEQ ID NO: 427 - protein, 325 aa, Homo sapiens
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLEWIEMPVMPDISAH

SEQ ID NO: 428 - protein, 319 aa, Homo sapiens
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGKFFSPWG

SEQ ID NO: 429 - protein, 1827 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEDLLTASKMEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQKDQEPTTDMLKQDSFPVSLEQAVTDSAMTSKTLEKAMTEPSALIEKSSIQELFEMRVDDKDKIEGVGAATSAELDMPFYEDKSGMSKYFETSALKEEATKSIEPGSDYYELSDTRESVHESIDTMSPMHKNGDKEFQTGKESQPSPPAQEAGYSTLAQSYPSDLPEEPSSPQERMFTIDPKVYGEKRDLHSKNKDDLTLSRSLGLGGRSAIEQRSMSINLPMSCLDSIALGFNFGRGHDLSPLASDILTNTSGSMDEGDDYLPATTPALEKAPCFPVESKEEEQIEKVKATGEESTQAEISCESPFLAKDFYKNGTVMAPDLPEMLDLAGTRSRLASVSADAEVARRKSVPSETVVEDSRTGLPPVTDENHVIVKTDSQLEDLGYCVFNKYTVPLPSPVQDSENLSGESGTFYEGTDDKVRRDLATDLSLIEVKLAAAGRVKDEFSVDKEASAHISGDKSGLSKEFDQEKKANDRLDTVLEKSEEHADSKEHAKKTEEAGDEIETFGLGVTYEQALAKDLSIPTDASSEKAEKGLSSVPEIAEVEPSKKVEQGLDFAVQGQLDVKISDFGQMASGLNIDDRRATELKLEATQDMTPSSKAPQEADAFMGVESGHMKEGTKVSETEVKEKVAKPDLVHQEAVDKEESYESSGEHESLTMESLKADEGKKETSPESSLIQDEIAVKLSVEIPCPPAVSEADLATDERADVQMEFIQGPKEESKETPDISITPSDVAEPLHETIVSEPAEIQSEEEEIEAQGEYDKLLFRSDTLQITDLGVSGAREEFVETCPSEHKGVIESVVTIEDDFITVVQTTTDEGESGSHSVRFAALEQPEVERRPSPHDEEEFEVEEAAEAQAEPKDGSPEAPASPEREEVALSEYKTETYDDYKDETTIDDSIMDADSLWVDTQDDDRSIMTEQLETIPKEEKAEKEARRSSLEKHRKEKPFKTGRGRISTPERKVAKKEPSTVSRDEVRRKKAVYKKAELAKKTEVQAHSPSRKFILKPAIKYTRPTHLSCVKRKTTAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 430 - protein, 471 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 431 - protein, 502 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVRILNKKIDFSKVQSRCGSKDNIKHSAGGGNVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 432 - protein, 455 aa, Homo sapiens
MDAALKRSRSEEPAEILPPARDEEEEEEEGMEQGLEEEEEVDPRIQGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQSSTSPEGQALENRMKQLSLQCSKGRDGIIADIKMVQIG

SEQ ID NO: 433 - protein, 247 aa, Homo sapiens
MTRQRVWMRWAVRQPWSFSNIVSWLTSSGCWWRASTCTPCLPSPSSLSGSTSGGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 434 - protein, 409 aa, Homo sapiens
MRAGRRPRLGPWAGGCSKMWDNLTCWPATPRGQVVVLACPLIFKLFSSIQGRNVSRSCTDEGWTHLEPGPYPIACGLDDKAASLDEQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 435 - protein, 430 aa, Homo sapiens
MRAGRLQEECDYVQMIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 436 - protein, 457 aa, Homo sapiens
MRPPSPLPARWLCVLAGALAWALGPAGGQAARLQEECDYVQMIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 437 - protein, 942 aa, Homo sapiens
MASDAVQSEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 438 - protein, 661 aa, Homo sapiens
MIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMVSSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 439 - protein, 780 aa, Homo sapiens
MEQVEILRKFIQRVQAMKSPDHNGEDNFARDFMRLRRLSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMVSSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 440 - protein, 810 aa, Homo sapiens; identical to SEQ ID NO: 202

SEQ ID NO: 441 - protein, 810 aa, Homo sapiens; identical to SEQ ID NO: 202

SEQ ID NO: 442 - protein, 567 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 443 - protein, 773 aa, Homo sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCSSHTPIRRSTQRAQDVWQFSDGSSRALKF

SEQ ID NO: 444 - protein, 243 aa, Homo sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVLHTPPFGVVPRELKMCGSFRMEAREPLSSEKI

SEQ ID NO: 445 - protein, 229 aa, Homo sapiens
MARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 446 - protein, 125 aa, Homo sapiens
MARLALSPVPSHWMVALLLLLSAEPVPAARSEDRYRNPKGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 447 - protein, 776 aa, Homo sapiens
MNVRIFYSVSQSPHSLLSLLFYCAILESRISATMPLFKLPEIDDAMRNFAEKVFASEVKDEGGRQEISPFDVDEICPISHHEMQAHIFHLETLSTSTEARRKKRFQGRKTVNLSIPLSETSSTKLSHIDEYISSSPTYQTVPDFQRVQITGDYASGVTVEDFEIVCKGLYRALCIREKYMQKSFQRFPKTPSKYLRNIDGEAWVANESFYPVFTPPVKKGEDPFRTDNLPENLGYHLKMKDGVVYVYPNEAAVSKDEPKPLPYPNLDTFLDDMNFLLALIAQGPVKTYTHRRLKFLSSKFQVHQMLNEMDELKELKNNPHRDFYNCRKVDTHIHAAACMNQKHLLRFIKKSYQIDADRVVYSTKEKNLTLKELFAKLKMHPYDLTVDSLDVHAGRQTFQRFDKFNDKYNPVGASELRDLYLKTDNYINGEYFATIIKEVGADLVEAKYQHAEPRLSIYGRSPDEWSKLSSWFVCNRIHCPNMTWMIQVPRIYDVFRSKNFLPHFGKMLENIFMPVFEATINPQADPELSVFLKHITGFDSVDDESKHSGHMFSSKSPKPQEWTLEKNPSYTYYAYYMYANIMVLNSLRKERGMNTFLFRPHCGEAGALTHLMTAFMIADDISHGLNLKKSPVLQYLFFLAQIPIAMSPLSNNSLFLEYAKNPFLDFLQKGLMISLSTDDPMQFHFTKEPLMEEYAIAAQVFKLSTCDMCEVARNSVLQCGISHEEKVKFLGDNYLEEGPAGNDIRRTNVAQIRMAYRYETWCYELNLIAEGLKSTE

SEQ ID NO: 448 - protein, 210 aa, Homo sapiens
MEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLAFPEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 449 - protein, 568 aa, Homo sapiens
MERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVVTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRGWGLLDTMEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 450 - protein, 319 aa, Homo sapiens; identical to SEQ ID NO: 213

SEQ ID NO: 451 - protein, 319 aa, Homo sapiens; identical to SEQ ID NO: 213

SEQ ID NO: 452 - protein, 319 aa, Homo sapiens; identical to SEQ ID NO: 213

SEQ ID NO: 453 - protein, 287 aa, Homo sapiens
MLKKISVGVAGDLNTVTMKLGCVLMAWALYLSLGVLWVAQMLLAASFETLQCEGPVCTEESSCHTEDDLTDAREAGFQVKAYTFSEPFHLIVSYELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 454 - protein, 242 aa, Homo sapiens
MLKKISVGVAGDLNTVTMKLGCVLMAWALYLSLGVLWVAQMLLAAGCHAELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 455 - protein, 141 aa, Homo sapiens
MLKKISVGVAGDLNTVTMKLGCVLMAWALYLSLGVLWVAQMLLGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 456 - protein, 236 aa, Homo sapiens
MLKKISVGVAGDLNTVTMKLGCVLMAWALYLSLGVLWVAQMLLELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 457 - protein, 192 aa, Homo sapiens
MLKKISVGVAGDLNTVTMKLGCVLMAWALYLSLGVLWVAQMLLAASFETLQCEGPVCTEESSCHTEDDLTDAREAGFQVKAYTFSEPFHLIVSYGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 458 - protein, 376 aa, Homo sapiens
MLKKISVGVAGDLNTVTMKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 459 - protein, 759 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 460 - protein, 751 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKRCRVLRDAETSPGLR

SEQ ID NO: 461 - protein, 670 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 462 - protein, 278 aa, Homo sapiens
MDFWLWPLYFLPEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQRALDYGSQSGREGQGFHILIPTILGLFLLALLGLVVKRAVERRKALSRRARRLAVRMRALESSQRPRGSPRPRSQNNIYSACPRRARGADAAGTGEAPVPGPGAPLPPAPLQVSESPWLHAPSLKTSCEYVSLYHQPAAMMEDSDSDDYINVPA

SEQ ID NO: 463 - protein, 306 aa, Homo sapiens
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQSPLQAGPPTGREDARPGELPEAPRVAATALPKQHLQRLPAARSWSGRCRHRGGPRSRPRSAVAPRPAAGV

SEQ ID NO: 464 - protein, 245 aa, Homo sapiens
MTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYSAMATYSATCANNSPAQGINMANSIANLRLKAKEYSLQRNQVPTVN

SEQ ID NO: 465 - protein, 450 aa, Homo sapiens
MNLEGGGRGGEFGMSAVSCGNGKLRQWLIDQIDSGKYPGLVWENEEKSIFRIPWKHAGKQDYNREEDAALFKAWALFKGKFREGIDKPDPPTWKTRLRCALNKSNDFEELVERSQLDISDPYKVYRIVPEGAKKGAKQLTLEDPQMSMSHPYTMTTPYPSLPAQVHNYMMPPLDRSWRDYVPDQPHPEIPYQCPMTFGPRGHHWQGPACENGCQVTGTFYACAPPESQAPGVPTEPSIRSAEALAFSDCRLHICLYYREILVKELTTSSPEGCRISHGHTYDASNLDQVLFPYPEDNGQRKNIEKLLSHLERGVVLWMAPDGLYAKRLCQSRIYWDGPLALCNDRPNKLERDQTCKLFDTQQFLSELQAFAHHGRSLPRFQVTLCFGEEFPDPQRQRKLITAHVEPLLARQLYYFAQQNSGHFLRGYDLPEHISNPEDYHRSIRHSSIQE

SEQ ID NO: 466 - protein, 439 aa, Homo sapiens
MSKTMAMNLLEDWCRGMEVDIHRSLLVTGIPEDCGQAEIEETLNGVLSPLGPYRVLNKIFVREENVKAALIEVGEGVNLSTIPREFPGRGGVWRVVCRDPTQDAEFLKNLNEFLDAEGRTWEDVVRLLQLNHPTLSQNQHQPPENWAEALGVLLGAVVQIIFCMDAEIRSREEARAQEAAEFEEMAAWALAAGRKVKKEPGLAAEVGSALKAETPNNWNATEDQHEPTKPLVRRAGAKSRSRRKKQKKNSRQEAVPWKKPKGINSNSTANLEDPEVGDAESMAISEPIKGSRKPCVNKEELALKKPMAKCAWKGPREPPQDARAEAESPGGASESDQDGGHESPPKKKAVAWVSAKNPAPMRKKKKVSLGPVSYVLVDSEDGRKKPVMPKKGPGSRREASDQKAPRGQQPAEATASTSRGPKAKPEGSPRRATNESRKV

SEQ ID NO: 467 - protein, 1507 aa, Homo sapiens
MPRRRPPASGAAQFPERIATRSPDPIPLCTFQRQPRAAPVQPPCRLFFVTFAGCGHRWRSESKPGWISRSRSGIALRAARPPGSSPPRPAAPRPPPPGGVVAEAPGDVVIPRPRVQPMRVARGGPWTPNPAFREAESWSQIGNQRVSEQLLETSLGNEVSDTEPLSPASAGLRRNPALPPGPFAQNFSWGNQENLPPALGKIANGGGTGAGKAECGYETESHLLEPHEIPLNVNTHKFSDCEFPYEFCTVCFSPFKLLGMSGVEGVWNQHSRSASMHTFLNHSATGIREAGCRKDMPVSEMAEDGSEEIMFIWCEDCSQYHDSECPELGPVVMVKDSFVLSRARSWPASGHVHTQAGQGMRGYEDRDRADPQQLPEAVPAGLVRRLSGQQLPCRSTLTWGRLCHLVAQGRSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTDDKTFQCEMCFRFFSTNSNLSKHKKKHGDKKFACEVCSKMFYRKDVMLDHQRRHLEGVRRVKREDLEAGGENLVRYKKEPSGCPVCGKVFSCRSNMNKHLLTHGDKKYTCEICGRKFFRVDVLRDHIHVHFKDIALMDDHQREEFIGKIGISSEENDDNSDESADSEPHKYSCKRCQLTFGRGKEYLKHIMEVHKEKGYGCSICNRRFALKATYHAHMVIHRENLPDPNVQKYIHPCEICGRIFNSIGNLERHKLIHTGVKSHACEQCGKSFARKDMLKEHMRVHDNVREYLCAECGKGMKTKHALRHHMKLHKGIKEYECKECHRRFAQKVNMLKHCKRHTGIKDFMCELCGKTFSERNTMETHKLIHTVGKQWTCSVCDKKYVTEYMLQKHVQLTHDKVEAQSCQLCGTKVSTRASMSRHMRRKHPEVLAVRIDDLDHLPETTTIDASSIGIVQPELTLEQEDLAEGKHGKAAKRSHKRKQKPEEEAGAPVPEDATFSEYSEKETEFTGSVGDETNSAVQSIQQVVVTLGDPNVTTPSSSVGLTNITVTPITTAAATQFTNLQPVAVGHLTTPERQLQLDNSILTVTFDTVSGSAMLHNRQNDVQIHPQPEASNPQSVAHFINLTTLVNSITPLGSQLSDQHPLTWRAVPQTDVLPPSQPQAPPQQAAQPQVQAEQQQQQMYSY

SEQ ID NO: 468 - protein, 290 aa, Homo sapiens
MQGDARRRRNENYFDDIPRSKLERQMAQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVQIDPSEQKTLANLPWIVEPGQEAKRGINTKYETTIF

SEQ ID NO: 469 - protein, 357 aa, Homo sapiens
MANGFDNVQFMGSNVMEDQDLLEIGILNSGHRQRILQAIQLLPKMRPIGHDGYHPTSVAEWLDSIELGDYTKAFLINGYTSMDLLKKIWEVELINQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVIDPSEQKTLANLPWIVEPGQEAKRGINTKYETTIF

SEQ ID NO: 470 - protein, 394 aa, Homo sapiens
MGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVIDPSEQKTLANLPWIVEPGQEAKRGINTKYETTIF

SEQ ID NO: 471 - protein, 460 aa, Homo sapiens
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVPFCFKADRPI

SEQ ID NO: 472 - protein, 450 aa, Homo sapiens
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVQIDPSEQKTLANLPWIVEPGQEAKRGINTKYETTIF

SEQ ID NO: 473 - protein, 426 aa, Homo sapiens
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVQIDPSEQKTLANLPWIVEPGQEAKRGINTKYETTIF

SEQ ID NO: 474 - protein, 290 aa, Homo sapiens
MQGDARRRRNENYFDDIPRSKLERQMAQQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVIDPSEQKTLANLPWIVEPGQEAKRGINTKYETTIF

SEQ ID NO: 475 - protein, 266 aa, Homo sapiens
MQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVQIDPSEQKTLANLPWIVEPGQEAKRGINTKYETTIF

SEQ ID NO: 476 - protein, 254 aa, Homo sapiens
MQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 477 - protein, 414 aa, Homo sapiens
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 478 - protein, 510 aa, Homo sapiens
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVQIDPSEQKTLANLPWIVEPGQEAKRGINTKYETTIF

SEQ ID NO: 479 - protein, 212 aa, Homo sapiens
MGTRQTKGSLAERASPGAAPGPRRERPDFWASLLLRAGDKAGRAGAGMPPYHRRVGMVQELLRMVRQGRREEAGTLLQHLRQDLGMESTSLDDVLYRYASFRNLVDPITHDLIISLARYIHCPKPPQGCPGRKPPRQHSGPVGNPTDLPRPGAGDQLPTALWGAGRQRGAGLHRPHGRHGPAAAASTQHPAPPHHTGTQWQPVDPGRAARPH

SEQ ID NO: 480 - protein, 719 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSKHVIYAPSSHNKYAGESFPGIYDALFDIESKVDPSKAWGEVKRQIYVAAFTVQAAAETLSEVA

SEQ ID NO: 481 - protein, 704 aa, Homo sapiens
MTAGSSYPLFLAAYACTGCLAERLGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSKHVIYAPSSHNKYAGESFPGIYDALFDIESKVDPSKAWGEVKRQIYVAAFTVQAAAETLSEVA

SEQ ID NO: 482 - protein, 442 aa, Homo sapiens
MGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 483 - protein, 750 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 484 - protein, 192 aa, Homo sapiens
MAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRIEAATLTSMSWMPF

SEQ ID NO: 485 - protein, 188 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNEPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 486 - protein, 226 aa, Homo sapiens; identical to SEQ ID NO: 232

SEQ ID NO: 487 - protein, 561 aa, Homo sapiens
MADPQAGSAAGDWEIDVESLELEEDVCGAPRSTPPGPSPPPADGDCEDDEDDDGVDEDAEEEGDGEEAGASPGMPGQPEQRGGPQPRPPLAPQASPAGTGPRERCTPAGGGAEPRKLSRTPKCARCRNHGVVSCLKGHKRFCRWRDCQCANCLLVVERQRVMAAQVALRRQQATEDKKGLSGKQNNFERKAVYQRQVRAPSLLAKSILEGYRPIPAETYVGGTFPLPPPVSDRMRKRRAFADKELENIMLEREYKEREMLETSQAAALFLPNRMVPGPDYNSYKSAYSPSPVEPPSKDFCNFLPTCLDLTMQYSGSGNMELISSNVSVATTYRQYPLSSRFLVWPKCGPISDTLLYQQCLLNATTSVQALKPGASWDLKGARVQDGLSAEQDMMPSKLEGSLVLPHTPEIQTTRSDLQGHQAVPERSAFSPPRRNFSPIVDTDSLAAQGHVLTKISKENTRHPLPLRHNPFHSLFQQTLTDKSGPELKTPFVKEAFEETPKKHRECLVKDNQKYTFTIDRCAKDLFVAKQVGTKLSVNEPLSFSVESILKRPSSAITRVSQ

SEQ ID NO: 488 - protein, 541 aa, Homo sapiens; identical to SEQ ID NO: 234

SEQ ID NO: 489 - protein, 401 aa, Homo sapiens
MQGAQEASASEMLPLLLPLLWAASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSSFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHK

SEQ ID NO: 490 - protein, 389 aa, Homo sapiens
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSWMLRRPPLSTPDAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVISTSSRQA

SEQ ID NO: 491 - protein, 342 aa, Homo sapiens
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMGTLESGHPSNLTCSVPWVCEQGTPPIFSWMSAAPTSLGPRTTQSSVLTITPRPQDHSTNLTCQVTFPGAGVTMERTIQLNVSYAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWSSAPVPDRHSFRPPC

SEQ ID NO: 492 - protein, 437 aa, Homo sapiens
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSSFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHK

SEQ ID NO: 493 - protein, 353 aa, Homo sapiens
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSYAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWSSAPVPDRHSFRPPC

SEQ ID NO: 494 - protein, 856 aa, Homo sapiens
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 495 - protein, 851 aa, Homo sapiens
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQGGSFESPKKEKRSHRRWRSRAIGKDAKGTLQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 496 - protein, 820 aa, Homo sapiens
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 497 - protein, 235 aa, Homo sapiens
MAWQGLAAEFLQVPAVTRAYTAACVLTTAAVQLELLSPFQLYFNPHLVFRKFQVWRLVTNFLFFGPLGFSFFFNMLFVFRYCRMLEEGSFRGRTADFVFMFLFGGVLMTLLGLLGSLFFLGQALMAMLVYVWSRRSPRVRVNFFGLLTFQAPFLPWALMGFSLLLGNSILVDLLGIAVGHIYYFLEDVFPNQPGGKRLLQTPGFLKLLLDAPAEDPNYLPLPEEQPGPHLPPPQQ

SEQ ID NO: 498 - protein, 205 aa, Homo sapiens
MAWQGLAAEFLQVPAVTRAYTAACVLTTAAVQLELLSPFQLYFNPHLVFRKFQVWRLVTNFLFFGPLGFSFFFNMLFVFRYCRMLEEGSFRGRTADFVFMFLFGGVLMTLLGLLGSLFFLGQALMAMLVYVWSRRSPRVRVNFFGLLTFQAPFLPWALMGFSLLLGNSILVDLLGIAVGHIYYFLEDVFPNQPGGKRLLQTPGFL

SEQ ID NO: 499 - protein, 1033 aa, Homo sapiens
MGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRARNYYTDTSQKEAFHLEAREVYSVDPYNPAS

SEQ ID NO: 500 - protein, 218 aa, Homo sapiens
MKVGVLWLISFFTFTDGHGGFLGKNDGIKTKKELIVNKKKHLGPVEEYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRMSLLSPKLECNGTI

SEQ ID NO: 501 - protein, 373 aa, Homo sapiens
MSSPLASELSELAALRPGFRLSAPHARVAPRAATHARGRGRASHAGQPRLRSSCPGPSPGKRRVVPSGGAQPRVLPALSSRSHLFPMASHPQTRIQAYLEKNKIGPLFEELMTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLKMEPKNKGLKQQQQQHKKLLAAMLSQDSFESIHSPTPSVTEEDIDNEDDAMELLGNFKN

SEQ ID NO: 502 - protein, 1044 aa, Homo sapiens
MPAAGSNEPDGVLSYQRPDEEAVVDQGGTSTILNIHYEKEELEGHRTLYVGVRMPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSECQEMHGEFMGSACGHHGPYTPDVLFWSCILFFTTFILSSTLKTFKTSRYFPTRVRSMVSDFAVFLTIFTMVIIDFLIGVPSPKLQVPSVFKPTRDDRGWIINPIGPNPWWTVIAAIIPALLCTILIFMDQQITAVIINRKEHKLKKGCGYHLDLLMVAIMLGVCSIMGLPWFVAATVLSITHVNSLKLESECSAPGEQPKFLGIREQRVTGLMIFVLMGCSVFMTAILKFIPMPVLYGVFLYMGVSSLQGIQFFDRLKLFGMPAKHQPDFIYLRHVPLRKVHLFTLIQLTCLVLLWVIKASPAAIVFPMMVLALVFVRKVMDLCFSKRELSWLDDLMPESKKKKLDDAKKKAKEEEVIVLAPTVYLGASNYRT

SEQ ID NO: 503 - protein, 651 aa, Homo sapiens
MGPDRKEVPLSRGTQAVVVGKGRGAPGDDSSMGGRPSSPLDKQQRQHLRGQVDTLLRNFLPCYRGQLAASVLRQISRELGPQEPTGSQLLRSKKLPRVREHRGPLTQLRGHPPRWQPIFCVLRGDGRLEWFSHKEEYENGGHCLGSTALTGYTLLTSQREYLRLLDALCPESLGDHTQEEPDSLLEVPVSFPLFLQHPFRRHLCFSAATREAQHAWRLALQGGIRLQGTVLQRSQAPAARAFLDAVRLYRQHQGHFGDDDVTLGSDAEVLTAVLMREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKKFKSDSGLAQRRFIRGWGLCIFLPFVLSQLEPGCKKELPEFEGDVLAVGSQALTTEGIYEDVIRGCLLQRIDQELKKTLGANDVSCTLDGCLEVPWEQEGADEETEAEREGGACPRQPDSGAQIQPLCPPPSPGTFRS

SEQ ID NO: 504 - protein, 218 aa, Homo sapiens; identical to SEQ ID NO: 500

What is claimed herein is:

1. A method for treating chronic obstructive pulmonary disorder (COPD) or emphysema in a human subject in need of treatment for emphysematous damage by administering to the human subject a pharmaceutical composition comprising a GHK tripeptide.

2. The method of claim 1, wherein the composition is administered to the airspace of the lung.

3. The method of claim 2, wherein the composition is administered orally or nasally.

4. The method of claim 2, wherein the composition is administered using an inhaler or a nebulizer.

5. The method of claim 1, wherein the GHK is not complexed with copper.

6. The method of claim 1, wherein the human subject has been diagnosed with α-1 antitrypsin (AAT) deficiency.

7. The method of claim 1, wherein the human subject is administered an additional treatment for emphysema or COPD.

8. The method of claim 7, wherein the additional treatment for emphysema or COPD is selected from the group consisting of:
a bronchodilator; albuterol; ipratropium bromide; methylxanthine; steroids; antibiotics; and oxygen.

9. A method for treating emphysema in a human subject by administering to the subject a pharmaceutical composition comprising a GHK tripeptide.

10. The method of claim 1, wherein the active ingredient of the composition consists essentially of a GHK tripeptide.

11. A method for treating chronic obstructive pulmonary disorder (COPD) or emphysema in a human subject, the method comprising:
a) detecting the level of expression of at least two marker gene products from the group consisting of: SEQ ID NOs: 4; 12; 13; 18; 22; 23; 26; 30; 31; 32; 34; 37; 40; 55; 56; 58; 64; 71; 72; 131; 139-140; 144; 148-149; 152; 156-158; 160; 163; 166; 181-182; 184; 190; 197-198; 256-258; 279; 283-284; 286-287; 382-384; 405; 409-410; and 412-413;
b) administering to the human subject a pharmaceutical composition comprising a GHK tripeptide when the level of the at least two marker gene products is decreased relative to a reference level.

12. The method of claim 1, wherein the GHK tripeptide is linked to poly (alkyl) glycol.

13. A method for treating chronic obstructive pulmonary disorder (COPD) or emphysema in a human subject having decreased expression of at least 2 mRNAs selected from the group consisting of SEQ ID NOs: 1-79, 128-205, 253-316, and 379-442 or increased expression of at least 2 mRNAs selected from the group consisting of: SEQ ID NOs: 80-127, 206-252, 317-378, and 443-504 relative to a reference level by administering to the human subject a pharmaceutical composition comprising a GHK tripeptide.

* * * * *